US009913883B2

(12) United States Patent
Getts

(10) Patent No.: US 9,913,883 B2
(45) Date of Patent: *Mar. 13, 2018

(54) IMMUNE-MODIFYING NANOPARTICLES FOR THE TREATMENT OF INFLAMMATORY DISEASES

(71) Applicant: Cour Pharmaceuticals Development Company, Elmhurst, IL (US)

(72) Inventor: Daniel Getts, Washington, DC (US)

(73) Assignee: COUR Pharmaceuticals Development Company, Northbrook, IL (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/210,136

(22) Filed: Mar. 13, 2014

(65) Prior Publication Data

US 2015/0010631 A1 Jan. 8, 2015

Related U.S. Application Data

(60) Provisional application No. 61/779,182, filed on Mar. 13, 2013, provisional application No. 61/844,961, filed on Jul. 11, 2013, provisional application No. 61/865,392, filed on Aug. 13, 2013, provisional application No. 61/887,212, filed on Oct. 4, 2013.

(51) Int. Cl.
| | |
|---|---|
| *A61K 39/00* | (2006.01) |
| *A61K 9/14* | (2006.01) |
| *A61K 9/00* | (2006.01) |
| *A61K 31/00* | (2006.01) |
| *A61K 39/39* | (2006.01) |
| *A61K 31/01* | (2006.01) |
| *A61K 31/74* | (2006.01) |
| *A61K 31/765* | (2006.01) |
| *G01N 33/68* | (2006.01) |

(52) U.S. Cl.
CPC ........ *A61K 39/0005* (2013.01); *A61K 9/0019* (2013.01); *A61K 9/14* (2013.01); *A61K 31/00* (2013.01); *A61K 31/01* (2013.01); *A61K 31/74* (2013.01); *A61K 31/765* (2013.01); *A61K 39/001* (2013.01); *A61K 39/39* (2013.01); *G01N 33/6893* (2013.01); *G01N 2800/7095* (2013.01)

(58) Field of Classification Search
CPC ...... A61K 39/00; A61K 39/005; A61K 9/019; A61K 9/14; A61K 31/00
See application file for complete search history.

(56) References Cited

U.S. PATENT DOCUMENTS

| | | | |
|---|---|---|---|
| 2002/0131960 A1 | 9/2002 | Sadelain | |
| 2003/0166509 A1 | 9/2003 | Edwards | |
| 2004/0043075 A1 | 3/2004 | Ritter et al. | |
| 2006/0051407 A1* | 3/2006 | Richter | A61K 9/127 424/450 |
| 2007/0014752 A1* | 1/2007 | Roy | C08J 3/128 424/78.08 |
| 2009/0214474 A1 | 8/2009 | Jennings | |
| 2010/0015060 A1 | 1/2010 | Baldi | |
| 2011/0014292 A1 | 1/2011 | O'Hehir | |
| 2011/0135744 A1 | 6/2011 | Chin | |
| 2011/0182805 A1 | 7/2011 | Desimone | |
| 2011/0206773 A1* | 8/2011 | Lavik | A61K 9/0048 424/501 |
| 2011/0212172 A1 | 9/2011 | Kellum | |
| 2012/0076831 A1* | 3/2012 | Miller et al. | 424/400 |
| 2012/0263653 A1 | 10/2012 | Podobinski | |
| 2013/0011824 A1 | 1/2013 | Chan | |
| 2013/0323319 A1* | 12/2013 | Getts et al. | 424/501 |
| 2015/0010631 A1 | 1/2015 | Getts | |
| 2015/0174155 A1* | 6/2015 | Getts | A61K 9/0019 424/501 |

FOREIGN PATENT DOCUMENTS

| | | |
|---|---|---|
| WO | WO 01/12222 A1 | 2/2001 |
| WO | WO 03/043586 A2 | 5/2003 |
| WO | WO 03/092654 A1 | 11/2003 |
| WO | WO 2010/085509 | 7/2010 |
| WO | WO 2011/153532 | 12/2011 |
| WO | WO 2012/065153 | 5/2012 |
| WO | WO 2012/149252 | 11/2012 |
| WO | WO 2012/149255 | 11/2012 |
| WO | WO 2012/149454 | 11/2012 |
| WO | WO-2013/032829 A1 | 3/2013 |
| WO | WO 2013/192532 A2 | 12/2013 |

OTHER PUBLICATIONS

Lunov et al., Biomaterials, 2010, 31, 5063-5071.*
Schmidt et al., J. Immunol., 1999, 163, 3484-3490.*
Muller et al., J. Biomed Mater Res A, 2003, 66(1), pp. 55-61.*
Chang et al., Journal of Controlled Release, 2013, 170, pp. 287-294.*
Frohlich, et al., "The Role of Surface Charge in Cellular Uptake and Cytotoxicity of Medical Nanoparticles," International Journal of Nanomedicine, 7(31):5577, Oct. 2012.
International Search Report for PCT/US2011/060537 mailed Feb. 20, 2013, 3 pages.
International Search Report for PCT/US2014/026719 mailed Sep. 26, 2014, 7 pages.
McCauley, et al., "Comprehensive Follow-Up of the First Genome-Wide Association Study of Multiple Sclerosis Identifies KIF21B and TMEM39A as Susceptibility Loci, The International Multipke Sclerosis Genetics Consortium (IMSGC)," Human Molecular Genetics, 19(5):953-962, 2010.
Schrand, et al., "Nanodiamond Oarticles: Properties and Perspectives for Bioapplications," Critical Reviews in Solid State and Materials Sciences, 34:18-74, 2009.
Getts et al., "Microparticles bearing encephalitogenic peptides induce T-cell tolerance and ameliorate experimental autoimmune encephalomyelitis", Nature Biotechnol, 30:1217-1224 (2012).
Lo et al., "Simultaneous release of multiple molecules from poly(lactide-co-glycolide) nanoparticles assembled onto medical devices", Biomaterials, 30: 4889-4897 (2009).

(Continued)

*Primary Examiner* — Abigail Vanhorn
(74) *Attorney, Agent, or Firm* — Marshall, Gerstein & Borun LLP

(57) ABSTRACT

The current invention involves the administration of negatively charged particles, such as polystyrene, PLGA, or diamond particles, to subjects to ameliorate inflammatory immune responses. Additionally, the present invention describes methods of treating inflammatory diseases by administering these same negatively charged particles.

23 Claims, 43 Drawing Sheets

(56) References Cited

OTHER PUBLICATIONS

Muthu, "Nanoparticles based on PLGA and its co-polymer: An overview," Asian J. Pharm. 3(4):266-273 (2009).
Salvador-Morales et al., "Immunocompatibility properties of lipid-polymer hybrid nanoparticles with heterogeneous surface functional groups," Biomaterials 30:2231-2240 (2009).
Sampson and Armbrustmacher, "West Nile Encephalitis: The Neuropathology of Four Fatalities," Ann. N.Y. Acad. Sci. 951:172-178 (2001).
Tse, "Particulate promotion of tolerance", Nature Rev Drug Discovery 12: 22-23 (2013).
Dobrovolskaia and McNeil, "Immunological properties of engineered nanomaterials," Nat. Nanotechnol. 2:469-478 (2007).
Lamprecht et al., "Biodegradable Nanoparticles for Targeted Drug Delivery in Treatment of Inflammatory Bowel Disease," J. Pharmacol. Exp. Therapeutics 299(2):775-781 (2001).
Liu et al., "Biocompatible and detectable carboxylated nanodiamond on human cell," Nanotechnol. 18(32):325102, 10 pages (2007).
Supplementary European Search Report, EP appl. No. 11839890.8, 8 pages (Jun. 15, 2016).
Zolnik et al., "Minireview: Nanoparticles and the Immune System," Endocrinol. 151(2):458-465 (2010).
Getts, D.R., et al., "Therapeutic Inflammatory Monocyte Modulation Using Immune-Modifying Microparticles," Science Trans. Med. 2014;6(219):1-14.
Supplementary European Search Report, EP appl. No. 14773771.2, 9 pages. (dated Sep. 5, 2016).
Communication to European Patent Office Re: EP 14773771.2, Observations by third parties, 5 pages, dated Nov. 4, 2016.
Jilek, et al., "Modulation of allergic responses in mice by using biodegradable poly(lactide-co-glycolide) microspheres," J. Allergery Clin. Immunol., 114:943-950; Oct. 2004.
Kim, et al., "Suppression of Collagen-Induced Arthritis by Single Administration of Poly(Lactic-Co-Glycolic Acid) Nanoparticles Entrapping Type II Collagen, A Novel Treatment Strategy for Induction of Oral Tolerance," Arthritis & Rheumatism 46(4):1109-1120; Apr. 2002.
Delneste, Yves, et al., "Interferon-γ switches monocyte differentiation from dendritic cells to macrophages," Blood, 101(1):143-150, 2003.
Ellis, Terri N., et al., "Interferon-γ activation of polymorphonuclear neutrophil function," Immunology, 112:2-12, 2004.
Rao, Jianhua, et al., "T cells in Organ Ischemia Reperfusion Injury," Current Opinion in Organ Transplantation, 19(2):115-120. 2014.
Vieira, Pedro L., et al., "Development of Th1-Inducing Capacity in Myeloid Dendritic Cells Requires Environmental Instruction," The Journal of Immunology, 164:4507-4512, 2000.
Japanese patent application No. 2016-502223, Notice of Reasons for Rejection (English translation), dated Nov. 24, 2017.

* cited by examiner

Figure 5e
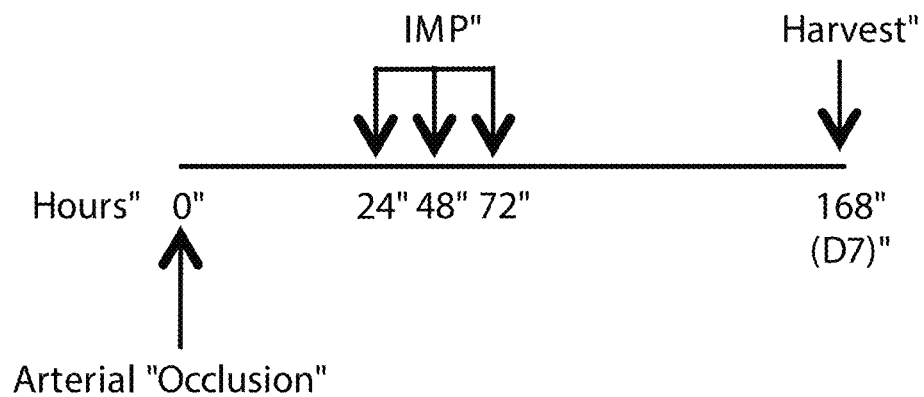
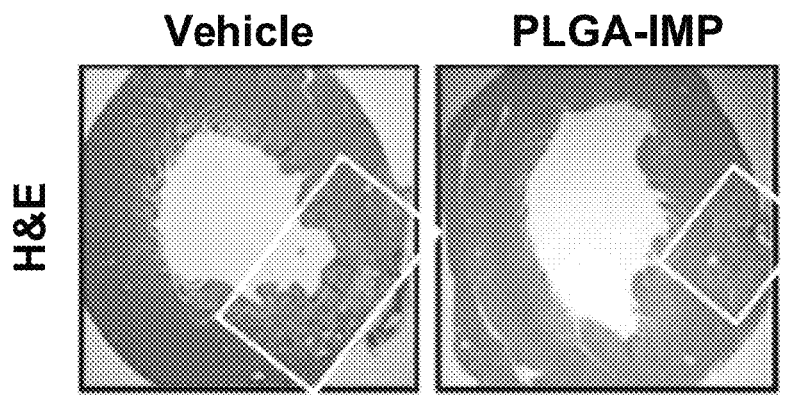
Figure 5f
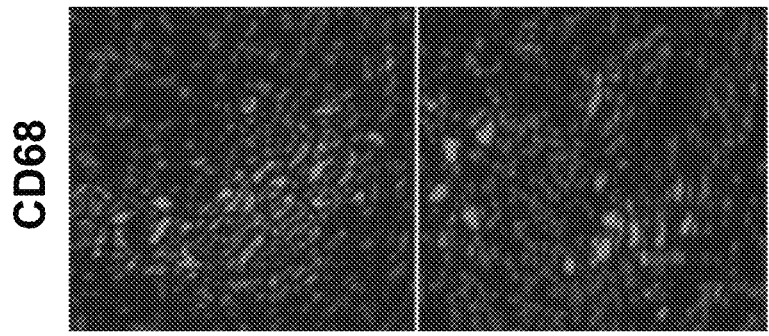
Figure 5g

CCL2

IFN-γ

IL-6

TNF

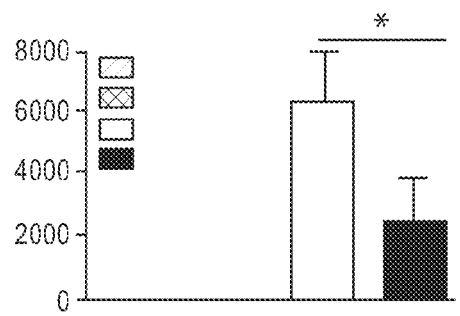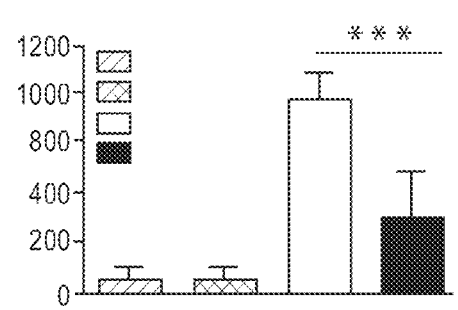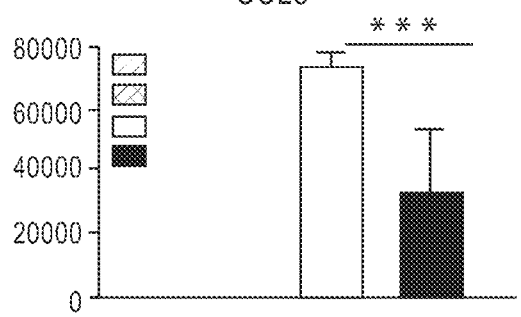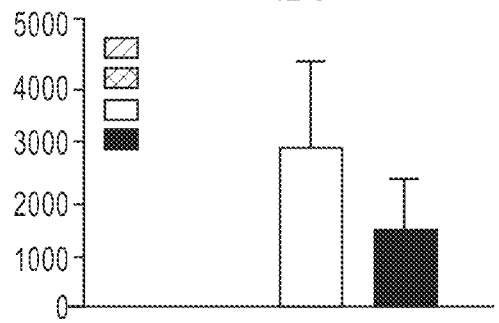

IL-12

CCL5

GM-CSF

Vehicle | PS-NP | PSB-IMP

Mock

WNV

Lectin Particles

Figure 7b

Vehicle | PS-NP | PS-IMP

Ly6C vs FITC

Mock

WNV

Gated on DC11b+ cells

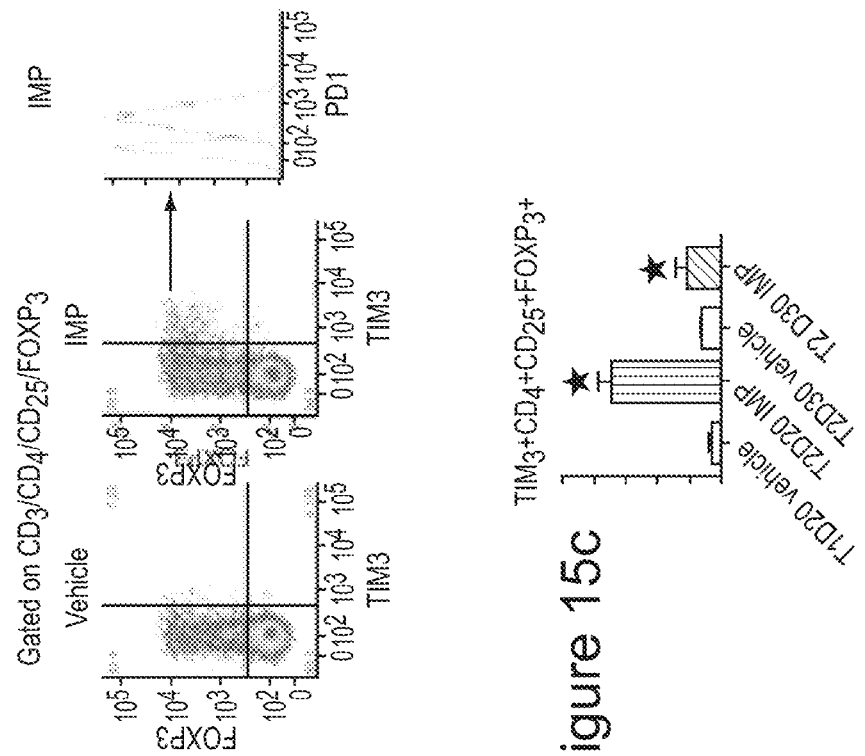
Figure 15b
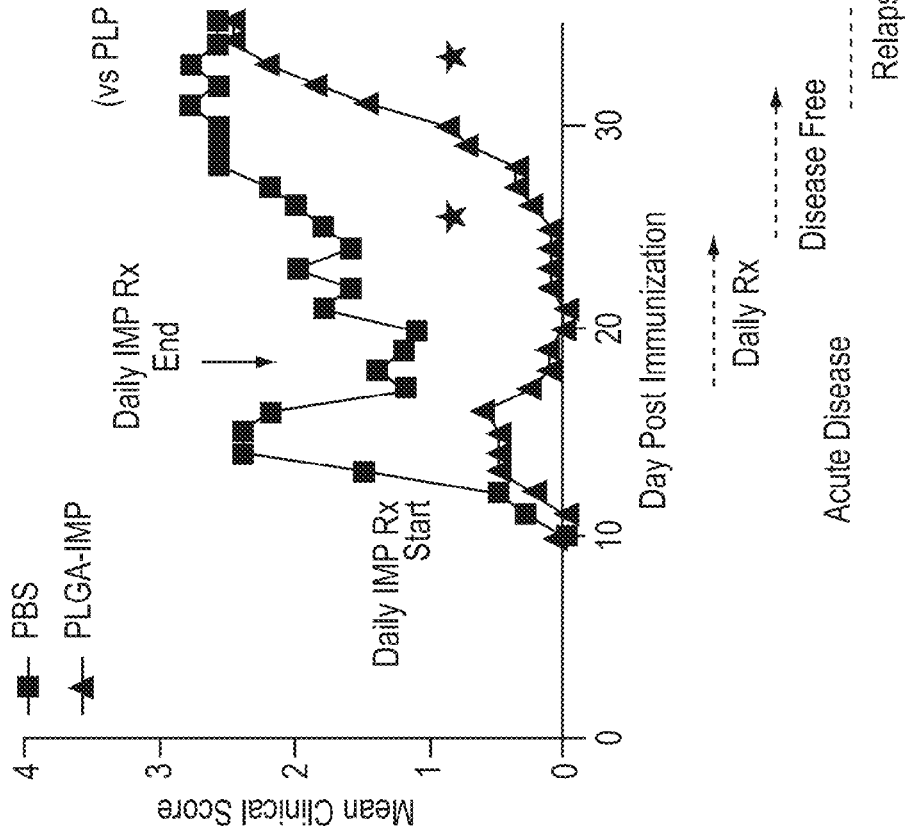
Figure 15a
Figure 15c

IMMUNE-MODIFYING NANOPARTICLES FOR THE TREATMENT OF INFLAMMATORY DISEASES

CROSS REFERENCE TO RELATED APPLICATIONS

This application claims priority to U.S. Provisional application Nos. 61/779,182, filed Mar. 13, 2013; 61/844,961, filed Jul. 11, 2013, 61/865,392, filed Aug. 13, 2013 and 61/877,212, filed Oct. 4, 2013, the contents of each of which is hereby incorporated by reference in their entirety.

DESCRIPTION OF THE TEXT FILE SUBMITTED ELECTRONICALLY

The contents of the text file submitted electronically herewith are incorporated herein by reference in their entirety: A computer readable format copy of the Sequence Listing (filename: COUR-001_01WO_ST25.txt, date recorded: Mar. 13, 2014, file size 1.2 megabytes).

BACKGROUND OF INVENTION

Inflammatory diseases and disorders are conditions in which an abnormal or otherwise deregulated inflammatory response contributes to the etiology or severity of disease. Examples include autoimmune diseases such as rheumatoid arthritis, multiple sclerosis, Celiac disease, and diabetes, infectious diseases such as tuberculosis and various forms of meningitis and encephalitis, including West Nile Virus encephalitis as well as ischemia reperfusion diseases such as myocardial infarction and transplant reperfusion injury. Additionally, the increase in inflammation observed after surgery, injury, or other tissue trauma can have deleterious effects on a patient's recovery.

Many of these diseases or disorders are characterized by a polynuclear/mononuclear cell infiltration at a site of tissue injury or other insult. Examples of mononuclear cells that have been observed in these infiltrations include lymphocytes, especially T lymphocytes, and cells of the mononuclear phagocyte system (MPS cells) such as monocytes, macrophages, dendritic cells, microglial cells and others.

Many of the cells observed in the mononuclear cell infiltrates are suspected of having a role in these abnormal inflammatory responses. For example, in diseases such as multiple sclerosis, CD4$^+$ T cells are known to play a central role in the pathologic autoimmune response. At an earlier time point in T cell activation, dendritic cells and other MPS cells may be responsible for activation of CD4$^+$ T cells. MPS cells could also contribute to inflammation through phagocytosis although in at least some inflammatory diseases it is not clear whether such cells would be capable of this in the absence of CD4$^+$ T cells.

Peripheral blood monocytes may be classified into one or more groups according to the expression or not of certain cell surface molecules. In particular, human "resident monocytes" or "mature monocytes" are understood to have a CD14$^{lo}$CD16$^+$ phenotype (the mouse counterpart is CX$_3$CR1$^{hi}$CCR2$^-$Gr1$^-$). Another group of cells, the "inflammatory monocytes" or "immature monocytes" are understood to have a CD14$^+$CD16$^-$ phenotype (the mouse counterpart is CX$_3$CR1$^{lo}$CCR2$^+$Gr1$^+$). (Geissmann F. et al. 2003 Immunity 19: 71-82)

Inflammatory monocytes have been found to play a role in a wide range of immune-mediated diseases and disorders. Upon entry into inflamed tissues, LY6C$^{hi}$ inflammatory monocytes differentiate into tissue macrophages or dendritic cells (DC) that may secrete numerous pro-inflammatory cytokines, proteases, and other mediators, including nitric oxide, culminating in tissue damage, scarring and even death. (Getts et al., 2008 J. Exp. Med. 205:2319-2337; Lin et al, 2011 J Immunol 186:508-515; Schiopu et al. 2012 Atherosclerosis 223:291-298; Swirski et al., 2010 J Clin Invest 120:2627-2634; Swirski et al, 2009 Science 325:612-616; Getts et al., J. Neuroinflamm. In press; Nahrendorf et al., 2010 Circulation 121:2437-2445). Inhibition of inflammatory monocytes not only reduces pathology, but may also enable early initiation of repair mechanisms in certain inflammatory conditions. To date, there is no safe and effective therapy for specifically targeting inflammatory monocytes that alters these outcomes. Physicians rely on broad-acting steroids, non-steroidal anti-inflammatory agents or antibodies that briefly neutralize components of the inflammatory monocyte response.

Considering the role of inflammatory monocytes and polymorphonuclear cells in most disease conditions, their therapeutic accessibility in the bloodstream, and their inherent propensity to interact with particles, particle-based therapeutics are potentially better equipped to specifically target these cells than antibodies or small molecules. To date, work in this area has focused on the formulation of delayed-release small-molecule therapeutics conjugated to nano- or micro-particles to enable enhanced delivery of cancer therapeutics or antigenic materials for vaccination purposes (De Jong et al., 2008 Int J Nanomedicine 3:133-149). However, the in vivo immune-modulating potential of particles themselves that do not carry active pharmaceutical ingredients has for the most part been overlooked.

Natural leukocyte clearance and the ability to induce apoptosis remains a primary goal for therapies that aim to reduce pathology associated with specific cell subsets including inflammatory derived macrophages and dendritic cells. It has been surprisingly found that immune-modified particles (IMPs) derived from polystyrene, nanodiamonds, or biodegradable poly(lactic-co-glycolic) acid, when infused are taken up by inflammatory monocytes through the macrophage receptor with collagenous structure (MARCO), triggering the migration and sequestration of monocytes in the spleen, where they undergo Caspase 3-mediated apoptosis. Perhaps more surprisingly, targeted administration of Immune-Modifying Particles (IMPs) in acute models of inflammation not only reduced inflammatory monocyte accumulation at the primary site of inflammation, but reduced pathology and disease severity in all models. IMPs are a versatile, readily translatable therapeutic option for diseases caused or potentiated by inflammatory monocytes. IMPs represent a novel and safe inflammatory monocyte specific therapy.

Regulatory T cells (or Tregs) are an immunomodulatory cell type important in controlling autoimmunity and general inflammation in the periphery. Tregs are CD4 positive cells that usually constitutively express CD25. Therefore Tregs are often CD4$^+$CD25$^+$ T cells. These regulatory T cells are potent suppressors of T cell mediated immunity in a range of inflammatory conditions including, but not limited to, infectious disease, autoimmunity, pregnancy and tumors. In vivo, a small number of Tregs can control large numbers of activated effector T cells. Although freshly isolated Tregs exhibit minimal constitutive suppressor functions, ligating the T cell antigen receptor (TCR) in vitro or pre-immunizing mice with high dose self antigen in vivo stimulates Treg suppressor function. The requirement for TCR ligation to enhance T cell suppressor function is paradoxical since most T cells are thought to recognize constitutively expressed self antigens.

It is desirable in inflammatory situations, such as autoimmune disease to enhance Treg suppressor function so as to decrease the inflammatory response to self proteins. Conversely, when attempting to mount an immune response to a tumor, for example, it may be desirable to switch off Treg function by either blocking the function of Tregs or reprogramming Tregs into effector T cells capable of an inflammatory immune response to a desired target.

SUMMARY OF THE INVENTION

The current invention involves the surprising finding that modified particles alone, that is, without a peptide coupled thereto, are effective in ameliorating the inflammatory immune response in patients in need thereof. Surprisingly, all that is necessary to dampen an inflammatory immune response, and treat inflammatory disease is the administration of negatively charged particles, without the need for coupling peptides thereto.

In one embodiment, the current invention provides a method of inducing monocyte, granulocyte and/or neutrophil apoptosis in a subject comprising administering to the subject a pharmaceutical composition comprising negatively charged particles and a carrier. In a further embodiment, the negatively charged particles are free from attached peptide or antigenic moieties. In some embodiments, the negatively charged particles are polystyrene particles. In other embodiments, the negatively charged particles are diamond particles. In still other embodiments, the negatively charged particles are poly(lactic-co-glycolic acid) (PLGA) particles. In some embodiments, the particles are PLURONICS® stabilized polypropylene sulfide particles. In still other embodiments, the negatively charged particles are carboxylated.

In one embodiment, the current invention provides a method of the induction and expansion of anti-inflammatory CD103+ dendritic cells and Regulatory T cells in a subject comprising administering to the subject a pharmaceutical composition comprising negatively charged particles and a carrier. In a further embodiment, the negatively charged particles are free from attached peptide or antigenic moieties.

In one embodiment, the current invention provides a method for removing pro-inflammatory mediators from the inflammatory milieu in a subject with an inflammatory disorder comprising administering to the subject a pharmaceutical composition comprising negatively charged particles and a carrier. In a further embodiment, the negatively charged particles are free from attached peptide or antigenic moieties. In some embodiments, the negatively charged particles are polystyrene particles. In other embodiments, the negatively charged particles are diamond particles. In still other embodiments, the negatively charged particles are poly(lactic-co-glycolic acid) (PLGA) particles. In some embodiments, the particles are PLURONICS® stabilized polypropylene sulfide particles. In a further embodiment, the negatively charged particles are carboxylated. In a further embodiment, the negatively charged particles bind to the pro-inflammatory polypeptides produced in the subject.

In one embodiment, the current invention provides a method for concentrating and presenting regulatory proteins from the inflammatory milieu in a subject with an inflammatory disorder comprising administering to the subject a pharmaceutical composition comprising negatively charged particles and a carrier. In a further embodiment, the negatively charged particles are free from attached peptide or antigenic moieties. In some embodiments, the negatively charged particles are polystyrene particles. In other embodiments, the negatively charged particles are diamond particles. In still other embodiments, the negatively charged particles are poly(lactic-co-glycolic acid) (PLGA) particles. In some embodiments, the particles are PLURONICS® stabilized polypropylene sulfide particles. In a further embodiment, the negatively charged particles are carboxylated. In a further embodiment, the negatively charged particles bind to the regulatory proteins produced in the subject.

In still a further embodiment, the current invention provides a method for controlling a pathologic and/or unwanted inflammatory immune response in a subject comprising administering to the subject a pharmaceutical composition comprising negatively charged particles that have been pre-absorbed with regulatory proteins such that upon administration the negatively charged particles concentrate and present the regulatory proteins to ameliorate the inflammatory immune response in the subject. In a further embodiment, the negatively charged particles are free from attached peptide or antigenic moieties. In some embodiments, the negatively charged particles are polystyrene particles. In other embodiments, the negatively charged particles are diamond particles. In still other embodiments, the negatively charged particles are poly(lactic-co-glycolic acid) (PLGA) particles. In some embodiments, the particles are PLURONICS® stabilized polypropylene sulfide particles. In a further embodiment, the negatively charged particles are carboxylated.

In one embodiment, the current invention provides a method of inducing antigen specific tolerance in a subject comprising administering to said subject a pharmaceutical composition comprising negatively charged particles with one or more antigens embedded therein, and a carrier. In a further embodiment, the negatively charged particles are free from attached peptide or antigenic moieties. In some embodiments, the negatively charged particles are polystyrene particles. In other embodiments, the negatively charged particles are diamond particles. In still other embodiments, the negatively charged particles are poly(lactic-co-glycolic acid) (PLGA) particles. In some embodiments, the particles are PLURONICS® stabilized polypropylene sulfide particles. In a further embodiment, the negatively charged particles are carboxylated. In a further embodiment, the negatively charged particles bind to the pro-inflammatory polypeptides produced in the subject.

In one embodiment, the particles are coupled to an antigen comprising one or more epitopes. In a further embodiment, the epitope is associated with an allergy, an autoimmune disease, or an inflammatory disease or disorder. In one embodiment, the epitope is associated with type 1 diabetes, multiple sclerosis, Celiac's disease, or inflammatory bowel disease, including Crohn's disease or colitis, e.g. ulcerative colitis. In one embodiment, the epitope is an epitope described in Tables 1 or 2. In one embodiment, the particles are coupled to antigens comprising only one epitope associated with one disease and/or disorder. In a further embodiment, antigens comprise more than one epitope associated with the same disease and/or disorder. In a further embodiment, the antigens comprise more than one epitope associated with different diseases and/or disorders.

In one embodiment, the negatively charged particles have a zeta potential of less than about −100 mV. In another embodiment, the negatively charged particles have a zeta potential of less than about −50 mV. In one embodiment, the negatively charged particles have a zeta potential between −100 mV and 0 mV. In some embodiments, the negatively charged particles with a zeta potential between −75 mV and 0 mV are carboxylated. In another embodiment, the negatively charged particles have a zeta potential between −60 mV and 0 mV. In another embodiment, the negatively charged particles have a zeta potential between −50 mV and 0 mV. In a particular embodiment, the negatively charged particles have a zeta potential between −50 mV and −40 mV. In another embodiment, the charged particles have a zeta potential between −100 mV and −50 mV. In one embodiment, the charged particles have a zeta potential between −75 mV and −50 mV.

In one embodiment, the pharmaceutical formulations of the current invention decrease and/or inhibit the infiltration of inflammatory monocytes to inflammatory foci. In another embodiment, the pharmaceutical formulations of the current invention ameliorate an inflammatory immune response.

In one embodiment, the pharmaceutical formulations of the current invention increase the number of regulatory T cells. In another embodiment, the pharmaceutical formulations of the current invention ameliorate an inflammatory immune response.

In one embodiment, the pharmaceutical formulations of the current invention comprise negatively charged particles with an average diameter of about 0.1 µm to about 10 µm. In another embodiment the negatively charged particles have an average diameter of about 0.2 µm to about 2 µm. In a further embodiment, the negatively charged particles have an average diameter of about 0.3 µm to about 5 µm. In yet a further embodiment the negatively charged particles have an average diameter of about 0.5 µm to about 3 µm. In still a further embodiment, the negatively charged particles have an average diameter of about 0.5 µm.

In one embodiment, the subject has undergone or will undergo surgery. In a further embodiment, the negatively-charged particles are administered to the subject before surgery. In yet a further embodiment, the negatively-charged particles are administered to the subject during surgery. In yet a further embodiment, the negatively-charged particles are administered to the subject after surgery. In another embodiment, the subject is a transplant recipient.

In a further embodiment, the subject has recently experienced physical trauma. In a further embodiment, the subject has recently experienced an injury. In yet a further embodiment, the injury is a sports injury. In a further embodiment, the injury is a concussion.

In one embodiment, the subject has an autoimmune disorder. In a further embodiment the autoimmune disorder is multiple sclerosis, scleroderma, type-I diabetes, rheumatoid arthritis, thyroiditis, systemic lupus erythematosus, Reynaud's syndrome, Sjorgen's syndrome, autoimmune uveitis, autoimmune myocarditis, inflammatory bowel disease, Amyotrophic Lateral Sclerosis (ALS), Celiac disease, ulcerative colitis, or Crohn's disease. In a particular embodiment, the autoimmune disease is multiple sclerosis. In a further embodiment, the autoimmune disease is Celiac disease. In a further embodiment, the autoimmune disease is type 1 diabetes. In a further embodiment, the autoimmune disease is inflammatory bowel disease, including Crohn's disease and ulcerative colitis.

In one embodiment, the subject has an allergic disorder. In a further embodiment, the allergic disorder is eczema, asthma, allergic rhinitis or skin hypersensitivity. In another embodiment, the subject is a transplant recipient.

In one embodiment, the subject has ischemic reperfusion injury, atherosclerosis, or has suffered from a cardiac infarction. In another embodiment, the subject has psoriasis or dermatitis.

In one embodiment, the subject has a viral infection. In a further embodiment, the viral infection is a herpes virus infection, a hepatitis virus infection, a west nile virus infection, a flavivirus, an influenza infection, a rhinovirus infection, a papillomavirus infection, a or parainfluenza virus infection. In a further embodiment, the viral infection infects the central nervous system of said subject. In still a further embodiment, the viral infection causes viral encephalitis or viral meningitis.

In one embodiment, the subject has a bacterial infection. In a further embodiment, the bacterial infection infects the central nervous system of said subject. In still a further embodiment, the bacterial infection causes sepsis bacterial encephalitis or bacterial meningitis.

In a further embodiment, the administration of the particles of the invention prevents the accumulation of potentially pathology causing neutrophils and other granulocytes in a subject. In a further embodiment, the subject has cancer.

In one embodiment, administration of the particles of the invention increases regeneration of damaged tissue in a subject. In one embodiment, administration of the particles of the invention increases regeneration of damaged tissue in a subject with amyotrophic lateral sclerosis (ALS) or post traumatic stress disorder (PTSD). In a further embodiment, administration of the particles increases regeneration of epithelial cells. In yet a further embodiment, administration of the particles increases remyelination of neurons. In another embodiment, the subject has an autoimmune disease. In yet another embodiment, the subject has inflammatory bowel disease, ulcerative colitis, and/or Crohn's disease. In yet another embodiment, the subject has multiple sclerosis. In one embodiment, administration of the negatively charged particles induces antigen-specific tolerance in a subject. In one embodiment, the particles that induce antigen-specific tolerance comprise one or more epitopes associated with an allergy, autoimmune disease, and/or inflammatory disease. In one embodiment, the epitopes are selected from those described in Tables 1 or 2. In one embodiment, the negatively charged particles are polystyrene, diamond, PLURONICS® stabilized polypropylene sulfide, or poly(lacti-co-glycolic acid) particles. In one embodiment the particles are carboxylated. In one embodiment, the particles have a zeta potential of less than about −100 mV. In one embodiment, the particles have a zeta potential between about −75 mV and 0 mV, for example, between −50 mV and 0 mV, or between −100 mV and −50 mV or between −75 mV and −50 mV or between −50 mV and −40 mV. In one embodiment, the particle has an average diameter of about 0.1 µm to about 10 µm, for example from about 0.2 µm to about 2 µm or about 0.3 µm to about 5 µm, or 0.5 µm to about 3 µm or about 0.5 µm to about 1 µm.

In one embodiment, the subject has an autoimmune disease. In one embodiment, the autoimmune disease is multiple sclerosis, scleroderma, type-I diabetes, rheumatoid arthritis, thyroiditis, systemic lupus erythematosus, Reynaud's syndrome, Sjorgen's syndrome, autoimmune uveitis, autoimmune myocarditis, inflammatory bowel disease, Amyotrophic Lateral Sclerosis (ALS), Celiac disease, ulcerative colitis, or Crohn's disease. In one embodiment, the particle comprises one or more myelin basic protein epitope. In one embodiment, the myelin basic protein epitope is one or more of SEQ ID NO: 4975 or SEQ ID NO: 4976. In one embodiment, the particles comprise one or more myelin oligodendrocyte glycoprotein epitope. In one embodiment, the myelin oligodendrocyte glycoprotein epitope is one or more of SEQ ID NO: 1 or SEQ ID NO: 4978. In one embodiment, the particle contains one or more insulin epitopes. In one embodiment, the one or more insulin epitopes is SEQ ID NO: 4981. In one embodiment, the particle comprises one or more glutamic acid decarboxylase epitopes. In one embodiment, the glutamic acid decarboxylase epitopes is SEQ ID NO: 4982. In one embodiment, the particle contains one or more proteolipid protein epitopes. In one embodiment, the proteolipid protein epitope is SEQ ID NO: 4977. In one embodiment, the particle comprises one or more gliaden epitopes. In one embodiment, the gliaden epitopes comprise SEQ ID NO: 4983-4985.

In one embodiment, the method includes administering the negatively charged particles by any suitable means. In one embodiment, the composition is administered orally, nasally, intravenously, intramuscularly, ocularly, transdermally, or subcutaneously. In a particular embodiment, the carboxylated particles are administered nasally. In still another embodiment, the negatively charged particles are administered intravenously. In still another embodiment, the negatively charged particles are administered subcutaneously.

In one embodiment, the method includes a method of diagnosing an inflammatory condition in a subject. In a particular embodiment, the method includes removing blood from a subject and incubating the blood, or serum/plasma derived therefore, with negatively charged particles and determining the presence or absence of the proteins listed in Table 6, wherein the presence of one or more proteins of Table 6 is indicative of an inflammatory immune response. In another embodiment, the method includes injecting a pharmaceutical composition comprising negatively charged particles into the circulation of a subject and subsequently removing the particles from the circulation and determining the presence or absence of the proteins listed in Table 6 on the surface of the particles removed from the subject wherein the presence of one or more proteins of Table 6 is indicative of an inflammatory immune response.

Figure 1A:
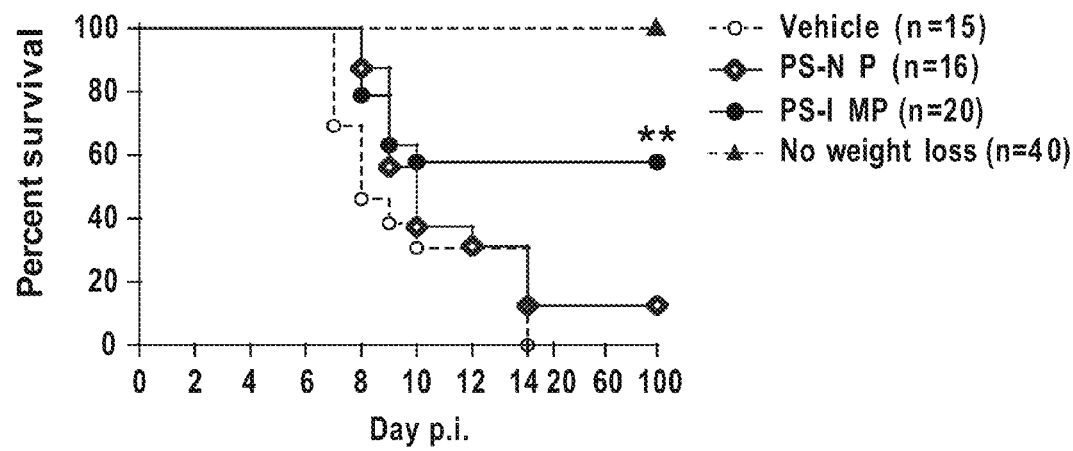
FIG. 1 shows (A-G) the ability of treatment of WNV-infected mice with PS-IMP to ameliorate disease pathology. Treatment of WNV-infected mice with PS-IMP at the time of ≥5% weight loss results in survival of 60% of mice that would otherwise succumb to disease (a). This effect was significantly diminished in mice treated with Polystyrene neutral particles (PSNP) and absent in vehicle controls (a). Infiltration of inflammatory monocyte-derived macrophages into the brain of WNV-infected mice on D7 p.i. was significantly reduced in mice treated with Polystyrene Immune Modifying Particles (PS-IMP), and to a lesser extent with NP (b). Treatment of WNV-infected animals with ploy (lactic-co-glycolic acid) immune modifying particles (PLGA-IMP) or nanodiamond (ND)-IMP also resulted in ~60% survival of mice that would otherwise succumb to infection (c). The negative charge of IMP is critical for this effect, as treatment of WNV-infected mice with polystyrene-based Polystyrene Positive Particles (PS-PP) did not reduce inflammatory monocyte macrophage infiltration into the brain on D7 p.i. (d) or improve survival (e). The optimal dose of PS-IMP to promote survival of WNV-infected mice was determined to be 0.355 mg, equivalent to ~4×10$^9$ particles (f, g). Survival data represents three separate experiments with 10-20 mice/group. Statistical analysis was conducted using the Mantel-Haenszel logrank test. Flow cytometry data are means±SD and represent three separate experiments with 4-5 mice/group. Statistical analysis was conducted using one-way ANOVA and Tukey-Kramer post-test. P≤0.05 (*), P≤0.01 (), P≤0.001 (*), in comparing PS-IMP and NP groups to vehicle control groups. P≤0.05 (#), P≤0.01 (##), P≤0.001 (###), in comparing PS-IMP to NP groups.

WT and MARCO$^{-/-}$ mice respond similarly to thioglycollate injection, as determined by the number of Ly6C$^{hi}$/CD11b$^+$ monocytes (ΦIM) isolated from the peritoneum (b, e). PS-IMP treatment (as shown in a), significantly reduced ΦIM infiltration into the peritoneal cavity at 48 hours in WT animals injected with thioglycollate but did not reduce ΦIM isolated from the peritoneal cavity of MARCO$^{-/-}$ mice (b, e). FITC-PS-IMP (green) were found in association with MARCO$^+$ (red fluorescence) cells in the marginal zone of the spleen (c). WNV infection upregulates MARCO expression on ΦIM (d). In thioglycollate-injected WT mice, PS-IMP treatment was associated with a significant increase in numbers of ΦIM in the spleen, which was not observed in MARCO$^{-/-}$ animals (b, e). Significantly higher numbers of PS-IMP$^+$ Ly6C$^{hi}$ ΦIM were isolated from spleens of thioglycolate-injected WT mice compared to MARCO$^{-/-}$ animals (O. Infusion of PS-IMP into thioglycolate-induced WT mice resulted in a significant increase in numbers of Ly6C$^{hi}$ ΦIM which expressed the apoptosis markers annexin V (g, h) and caspase-3 (i). This was not observed in MARCO$^{-/-}$ animals. Flow cytometry data are means±SD and represent three separate experiments with 4-5 mice/group. Statistical analysis was conducted using one-way ANOVA and Tukey-Kramer post-test. P≤0.05 (*), P≤0.01 (), P≤0.001 (*), in comparing the WT PS-IMP groups to all other groups.

FIG. 5 shows (A-P) PS-IMP ameliorate disease pathology and infiltration of inflammatory monocytes in EAE, myocardial inflammation and inflammatory bowel disease. PLGA-IMP infusion commencing at the onset of EAE (a) or primary relapse (b) in SJL mice immunized with PLP$_{139-151}$ significantly reduced mean clinical scores. Flow cytometry on spinal cords from mice treated with either PLGA-IMP or vehicle, for 7 days from day 7 post immunization, had significantly less inflammation, as determined by reduced CD45$^+$ CD11b$^+$ CD11c$^+$ Ly6C$^{hi}$ cells (c). This reduced monocyte influx into the spinal cord correlated with increased CD45$^+$ CD11b$^+$ Ly6C$^+$ monocytes in the spleen (d). As another model of inflammation, PLGA-IMP (infused as shown in e) were also tested in the permanent left anterior descending artery occlusion model. Three days of PLGA-IMP infusion, as shown in (e), resulted in reduced infarction size, as determined by H&E histology and image analysis described in the Materials and Methods, compared to vehicle-treated controls (f, h). In addition, the reduced occlusion size correlated with fewer CD68$^+$ macrophages in PLGA-IMP-treated mice compared to vehicle treated controls (g, i, red fluorescence). In another model of inflammation, the artery was ligated for 45 minutes and blood flow was allowed to return there after. Mice were treated with PLGA-IMP for 6 days as indicated in (j). At day 1 and day 5, serum creatinine clearance was significantly greater in animals that had been treated with IMP compared to vehicle treated controls (k). This correlated with reduced tubular atrophy in IMP treated animals (l). As another model of inflammation, PS-IMP therapy was tested in the DSS-induced colitis model, with infusion regimen for PS-IMP or vehicle shown in (m), reducing the overall clinical severity of DSS-induced colitis (n). Reduced clinical score correlated with reduced numbers of Gr-1$^+$ cells with monocytic (i.e., non-polymorphonuclear) morphology (o, p). EAE mean clinical score data are representative of three separate experiments with 10-20 mice/group. Flow cytometry data are means±SD and represent three separate experiments with 4-5 mice/group. Cardiac infarction data are representative of 2 experiments with at least 3 mice per group. Kidney ischemia reperfusion data are representative of 2 experiments with at least 4-5 mice per group. DSS-colitis data are representative of at least 3 experiments with at least 3 mice per group. Image analysis was performed as described in the Materials and Methods. Statistical analysis was conducted using unpaired, two-tailed Student T tests. P≤0.05 (*), P≤0.01 (), P≤0.001 (*) in comparing PS-IMP and vehicle control group. Statistical Analysis for the comparison by using two way analysis of variance (ANOVA) with post hoc Bonferroni's correction (Graph Pad Prism 6.0 software). *p<0.05, p<0.01, *p<0.001. n=5 for sham; n=7 per group for day 1; n=4-5 for day 5 for control group (as 3 animals were dead at days 3-4. We only collected one sample around day 4.3 so tubular score data was included) and n=7 for day 5 neg beads.

FIG. 6 shows (A-P) IMP treatment significantly reduces inflammatory cytokine levels in the WNV-infected brain. Mock-infected and WNV-infected mice were treated with PS-IMP on day 6 p.i. and brains were isolated and homogenized on day 7 p.i. Cytokine and chemokine levels were analyzed using multiplexed ELISA. Significantly reduced levels of CCL2 (a), IFN-γ (b), IL-6 (c), TNF (d), IL-10 (e), IL-4 (f), CCL3 (g), IL-12 (i), GM-CSF (k), IL-1α (l), IL-9 (n), IL-1β (o) and IL-2 (p) were observed in the brains of WNV-infected animals treated with IMP compared to controls. Levels of IL-3 (h), CCL5 (j) and IL-15 (m) were not significantly reduced with IMP treatment.

Figure 7C:
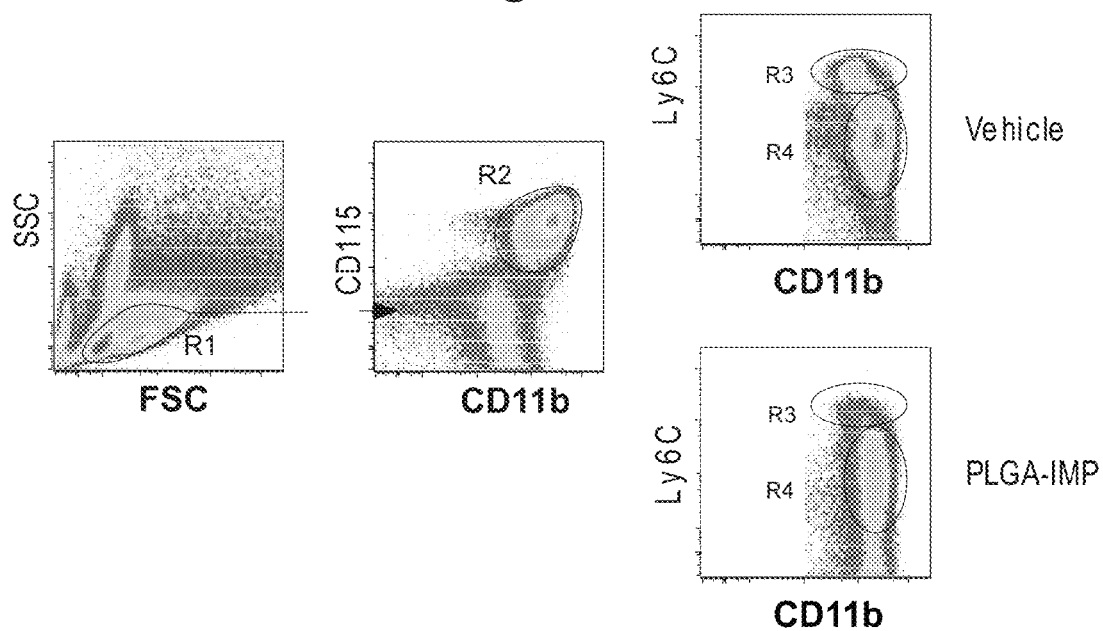
Figure 7D:
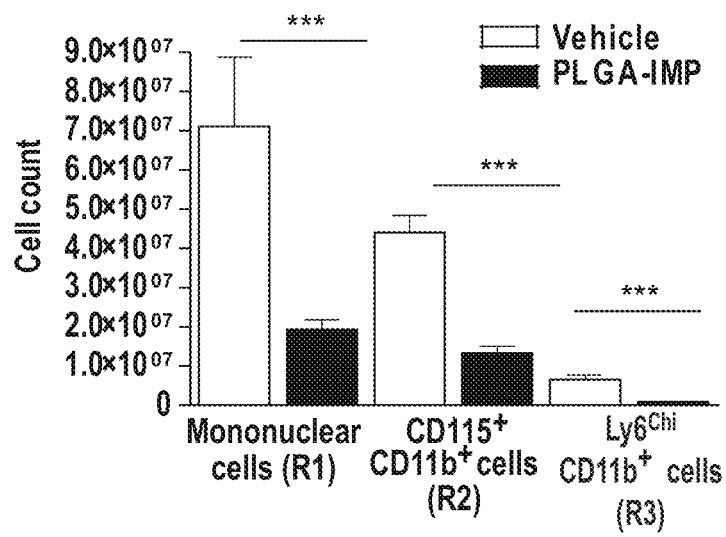
Figure 7E:
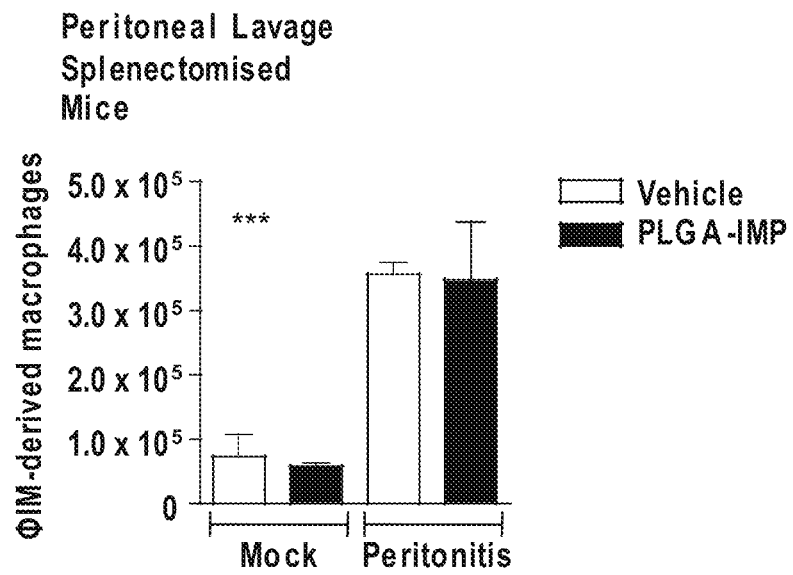

FIG. 7 shows (A-E) few IMPS are found in WNV infected brains, with IMP highly effective in reducing inflammatory monocytes in peritonitis. No Bright-blue NP or PS-IMP could be detected in the D7 p.i. WNV-infected brain by immunohistochemistry after injection on D6 p.i. (a). Similarly, FITC-NP or PS-IMP could not be detected in the WNV-infected brain by flow cytometry (b). PS-IMP were tested in a model of thioglycollate peritonitis in C57BL/6 mice. The infusion of PS-IMP 24 hours after thioglycollate infusion reduced the number of Ly6C$^{hi}$CD11b$^+$(R3) monocytes isolated from the peritoneum (e, d). This effect was abrogated in splenectomized mice (e). Particle immunohistochemistry and flow cytometry data represent three separate experiments, with at least 3 mice/group. Slides were counterstained with DAPI (blue) to identify cell nuclei. Thioglycollate data are representative of at least 3 experiments with 5 mice per group. Flow cytometry data are means±SD and represent three separate experiments with 4-5 mice/group.

FIG. 8 shows (A-F) IMPs promote accumulation of ΦIM in the spleen during EAE, myocardial infarction and repair of the epithelium in DSS-induced colitis. Significantly reduced infiltration of CD45$^+$ CD11b$^+$ monocyte-derived cells was observed in the day 14 EAE brain following PLGA-IMP infusion (a). The reduction of monocyte-derived cells in the brain corresponded with significant accumulation of (NM in the spleens of PLGA-IMP-treated animals, compared to vehicle-treated controls (b). Following myocardial infarction, significant accumulation of (NM in the spleen was observed in PLGA-IMP-treated animals, compared to vehicle-treated controls (c, d). Ki67$^+$ immunohistochemical stain of transverse colon on day 9 of DSS challenge (e), compared to H$_2$O control groups, revealed signature Ki67$^+$ staining in the epithelium, with relatively weak staining in DSS-challenged animals (e). Less crypt fallout was observed in DSS-challenged mice treated with PS-IMP (e). Furthermore, in these animals, Ki67$^+$ staining was more frequent and intense in the lamina propria. Image analysis comparing DSS-induced colitis vehicle versus PS-IMP (f) showed that the observed Ki67 differences were statistically significant. EAE data are means±SD and represent three separate experiments with 4-5 mice/group. Cardiac infarction data are representative of 2 experiments with at least 3 mice per group. DSS-colitis data are representative of at least 3 experiments with at least 3 mice per group. Image analysis was performed as described in the Materials and Methods. Statistical analysis was conducted using unpaired, two-tailed Student T tests. P≤0.05 (*), P≤0.01 (), P≤0.001 (*) in comparing PS-IMP and vehicle control group.

Figure 9:
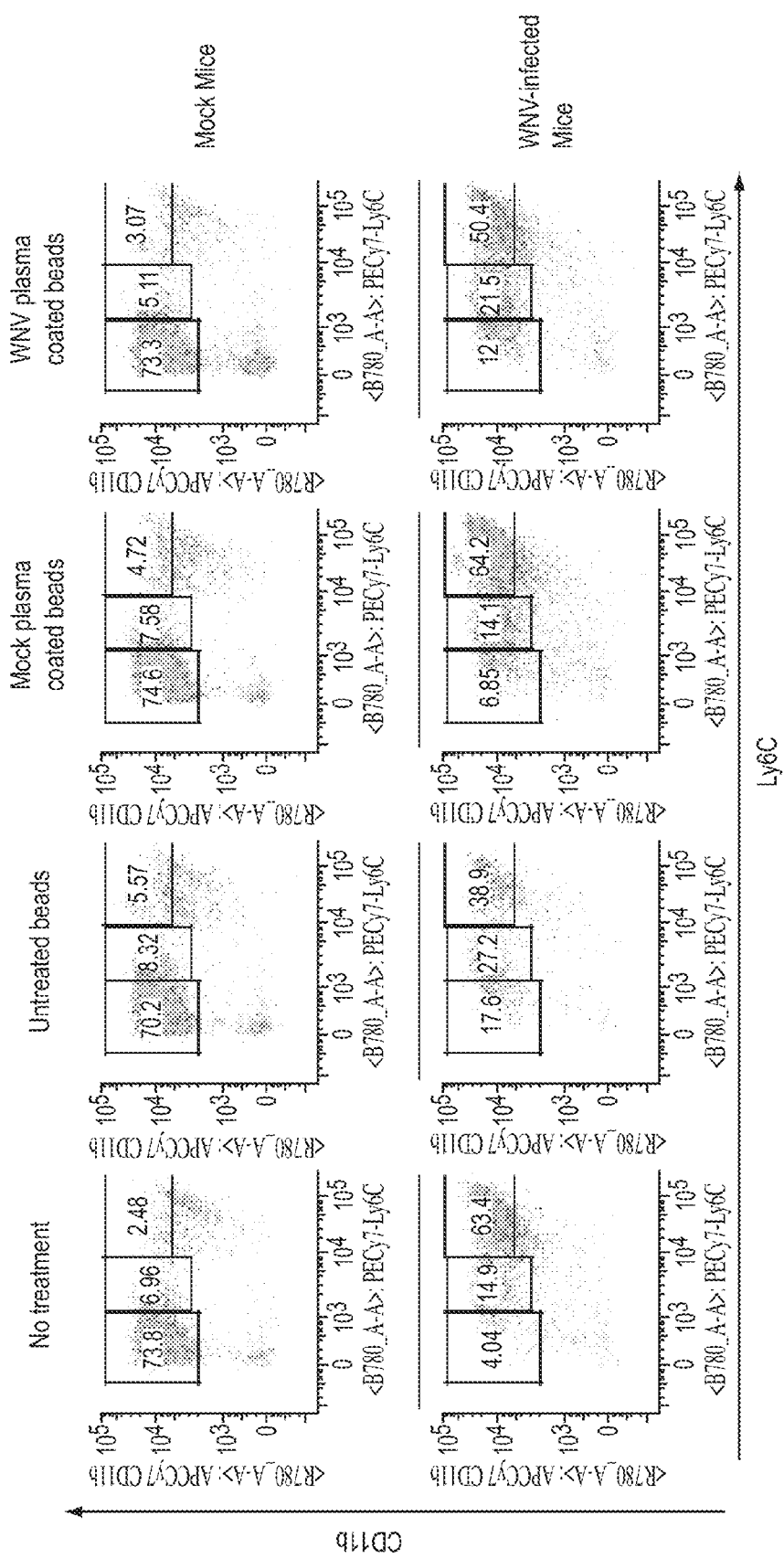

FIG. 9 shows opsonized IMP have reduced ability to inhibit macrophage migration to the brain. Day 7 plasma was taken from mock or WNV infected animals and incubated with PS-IMP. These "opsonized" particles or un-opsonized (untreated beads) particles were re-infused into WNV infected mice at day 6 p.i. On day 7 the brains were examined for inflammatory monocyte influx by flow cytometry. While untreated (Normal IMP) resulted in a reduced monocyte influx into the brain, mock plasma coated IMP had no ability to inhibit monocyte migration. Of interest WNV serum coated IMPs had a reduced ability to inhibit monocytes relative to uncoated IMP, but were still capable of reducing migration to some degree.

Figure 10A:
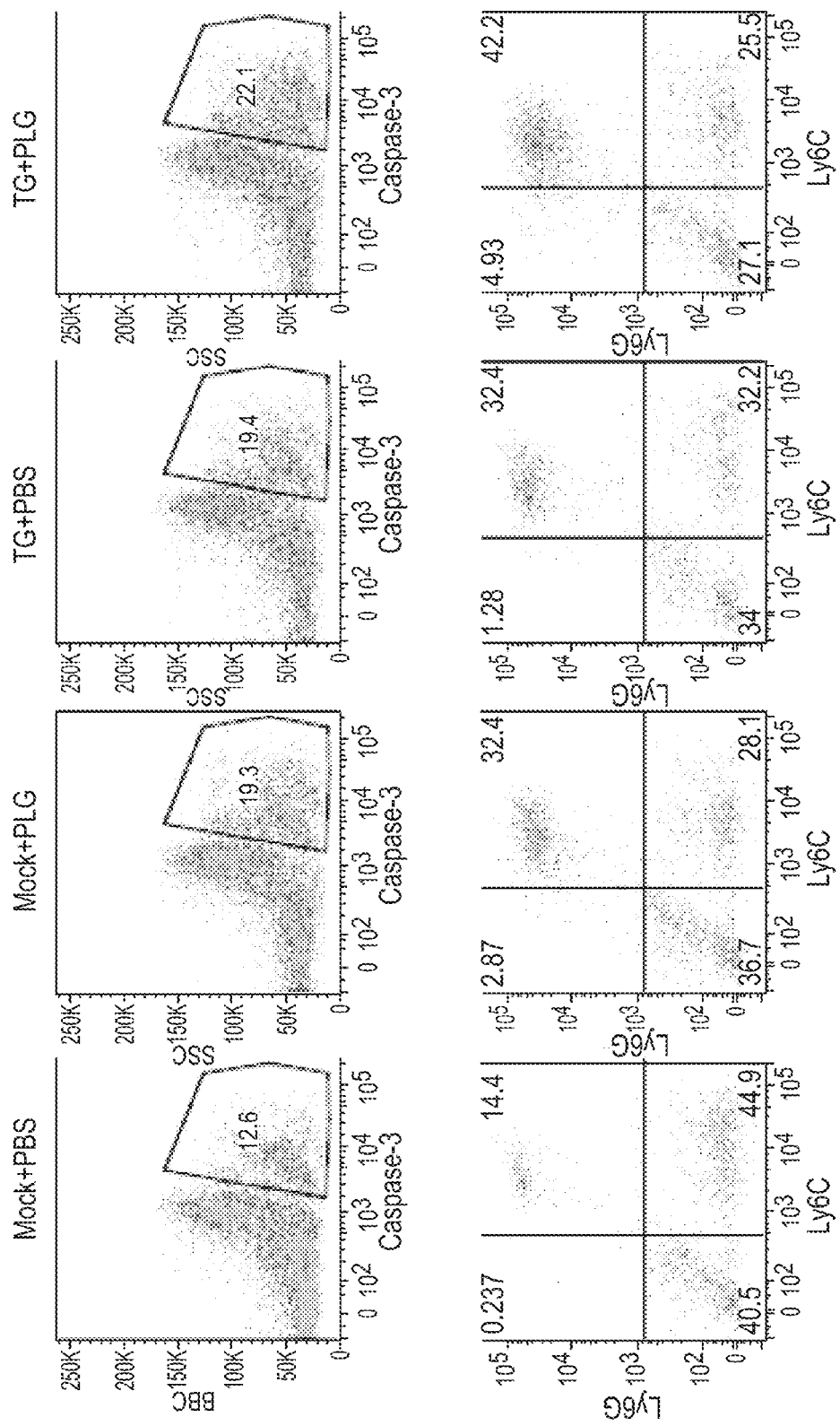
Figure 10B:
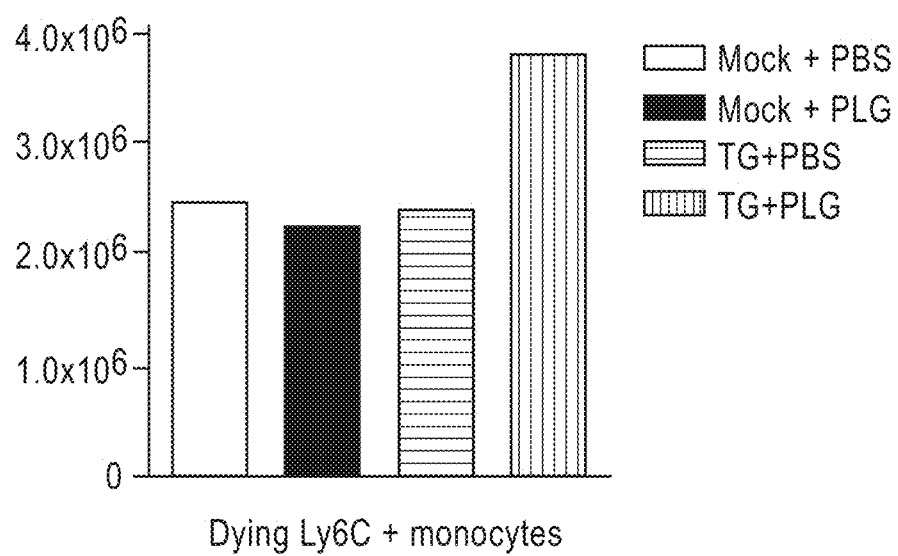
Figure 10B:
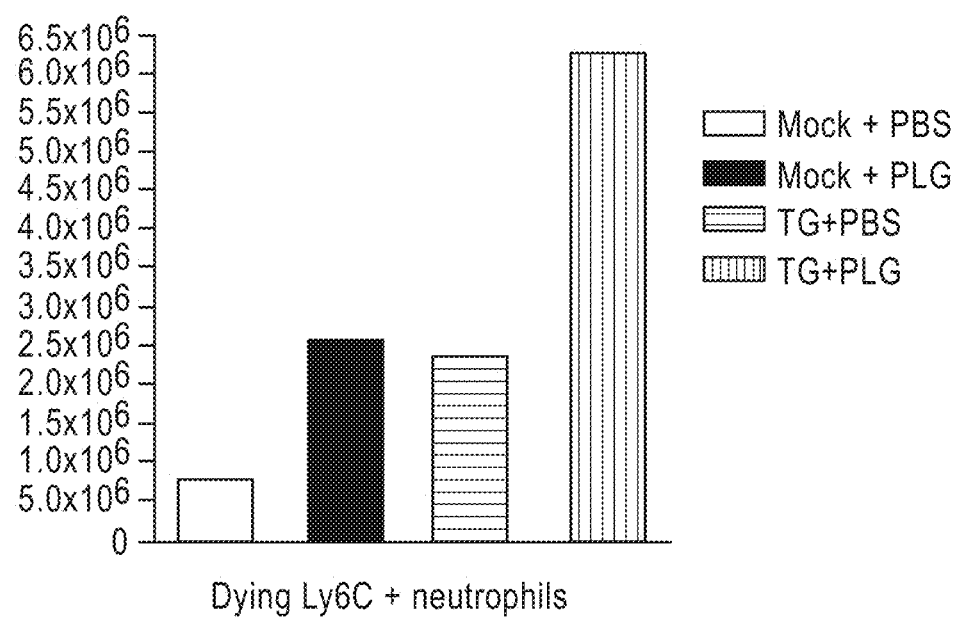

FIG. 10 shows PLGA-IMPs induce apoptosis in TG model in both inflammatory monocytes and neutrophils. Infusion of PLGA-IMP into thioglycolate-induced WT mice resulted in a significant increase in numbers of $Ly6C^{hi}$ ΦIM and $Ly6G^+$ Neutrophils which expressed the apoptosis markers annexin V and caspase-3. This was not observed in mock treated animals (a). Flow cytometry data are means and represent three separate experiments with 4-5 mice/group (b). Statistical analysis was conducted using one-way ANOVA and Tukey-Kramer post-test. P≤0.05 (*), P≤0.01 (), P≤0.001 (*), in comparing the WT PS-IMP groups to all other groups.

Figure 11:
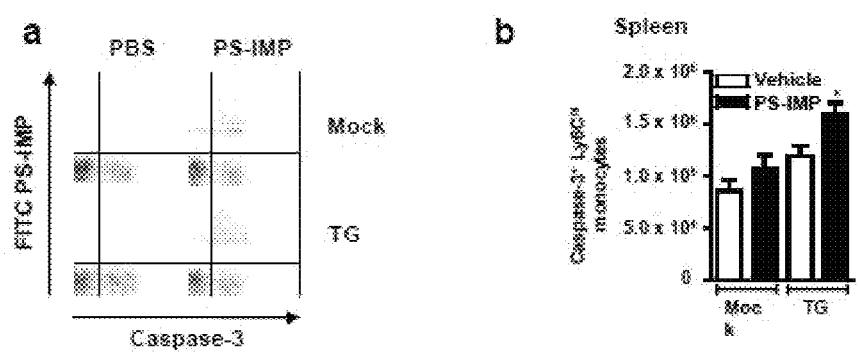

FIG. 11 shows (A-B) apoptosis can be detected within 2 hours post PLGA or PS IMP infusion. Two hours after injection, PS-IMPs were localized in CD11b+Ly6C+Ly6G- monocytes in the spleens of mock and TG peritonitis-induced mice. Uptake of PS-IMP was associated with activity of the enzyme Caspase-3, indicative of apoptosis (a). Increased numbers of monocytes were positive for caspase-3 activity in PS-IMP treated, TG peritonitis-induced mice (b).

Figure 12:
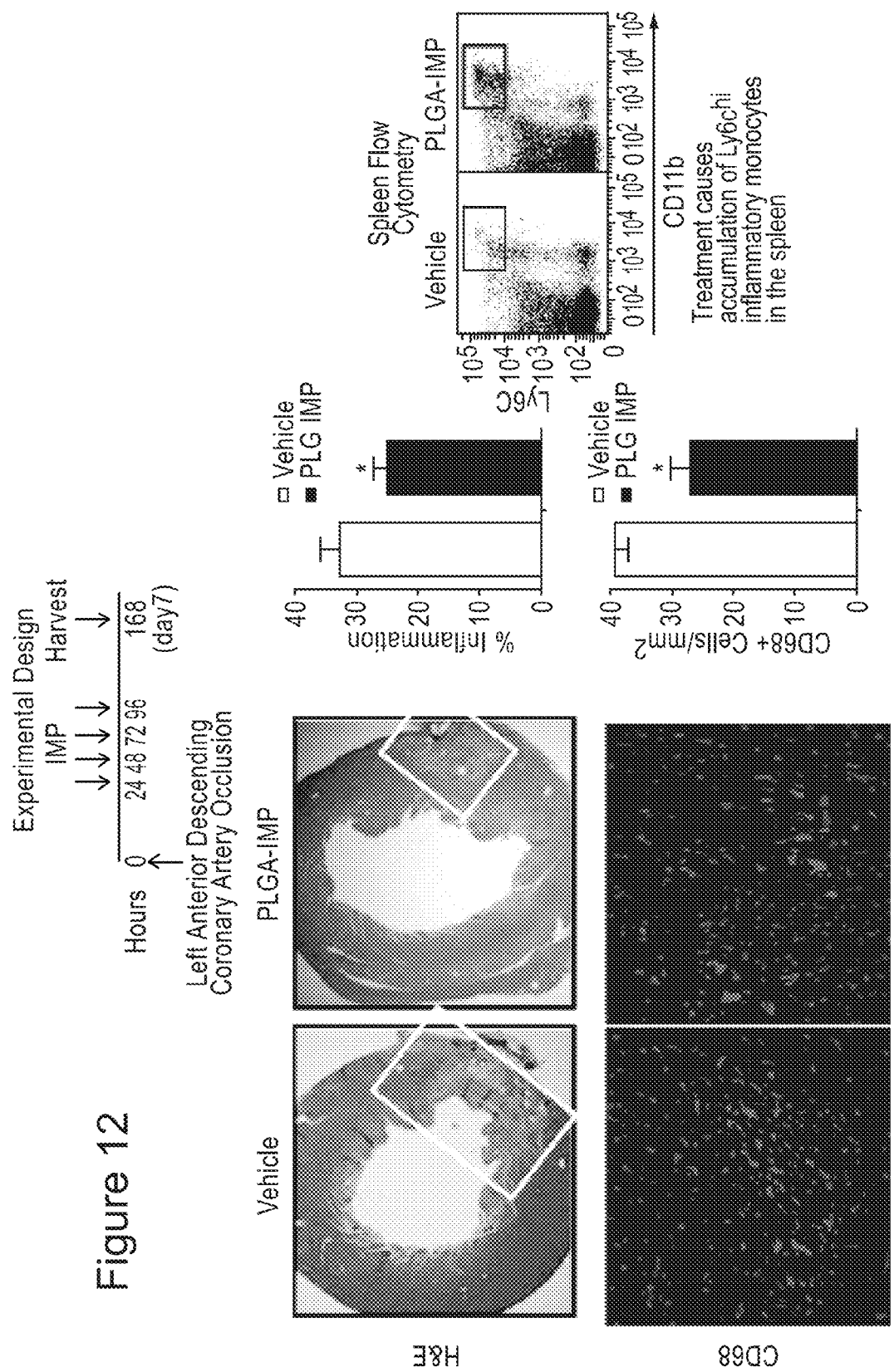

FIG. 12 shows that PLGA-IMPs protect from inflammatory damage in a myocardial infarction model. Four days of PLGA-IMP infusion resulted in reduced infarction size, as determined by H&E histology and image analysis compared to vehicle-treated controls. In addition, the reduced occlusion size correlated with fewer CD68+ macrophages in PLGA-IMP-treated mice compared to vehicle treated controls and an increase in $Ly6C^{hi}$ cells in the spleen.

Figure 13:
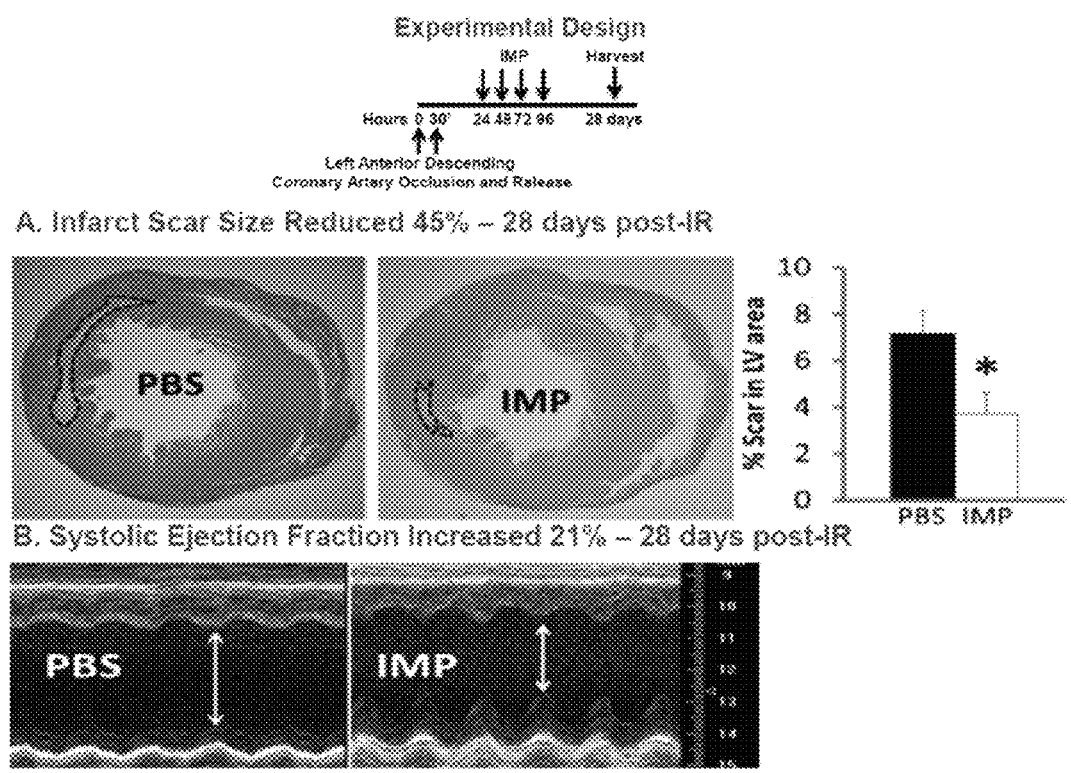

FIG. 13 shows that PLGA-IMP infusion protects from inflammatory damage in a myocardial ischemia (LAD occlusion)-reperfusion model. The coronary artery was occluded and blood flow was allowed to return after 30 minutes. Mice were treated with PLGA-IMP for 4 days. Treatment with PLGA-IMPs significantly reduced the infarct scar size and systolic ejection fraction compared with the PBS-control animals.

Figure 14:
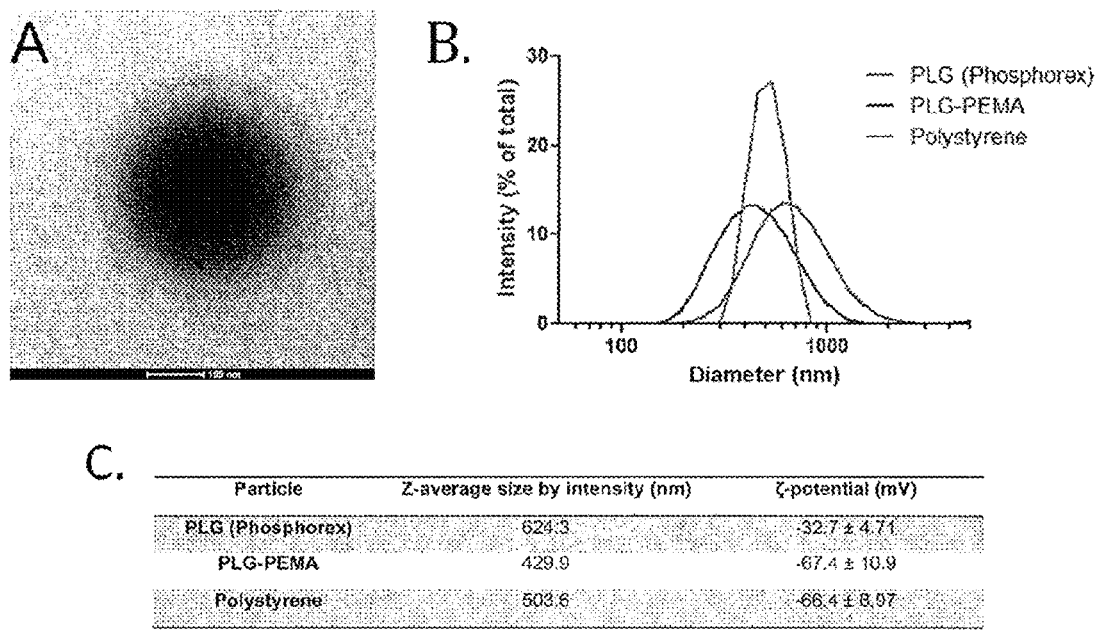

FIG. 14 shows (A) a micrograph of a poly(lactide-co-glycolide) (PLG) particle. B and C show the characterization of surface-functionalized poly(lactide-co-glycolide) particles by dynamic light scattering analysis, including the average size (nm) and ζ potential (mV) of PLG-PEMA particles. Surface-functionalized poly(lactide-co-glycolide) particles were analyzed on a Malvern Zetasizer Nano ZS (Malvern Instruments, Westborough, Mass.) at a count rate of $2.5 \times 10^5$ counts per second in 18.2 MΩ water. The population of surface-functionalized poly(lactide-co-glycolide) particles varied by 5-15% per batch but generally had a Z-average diameter of 567 nm, a peak diameter of 670 nm and a polydispersity index of 0.209.

FIG. 15 shows (A) shows that PLGA-IMP infusion protects from inflammatory damage in EAE. Upon treatment cessation, there is a disease free period, however, over time disease returns. (B) PLGA-IMP infusion (but not vehicle control) results in the expansion and induction of regulatory T cells that express anti-inflammatory proteins like PD-1. (C) These Tregs are most abundant during IMP treatment, and wane over time after treatment cessation.

Figure 16:
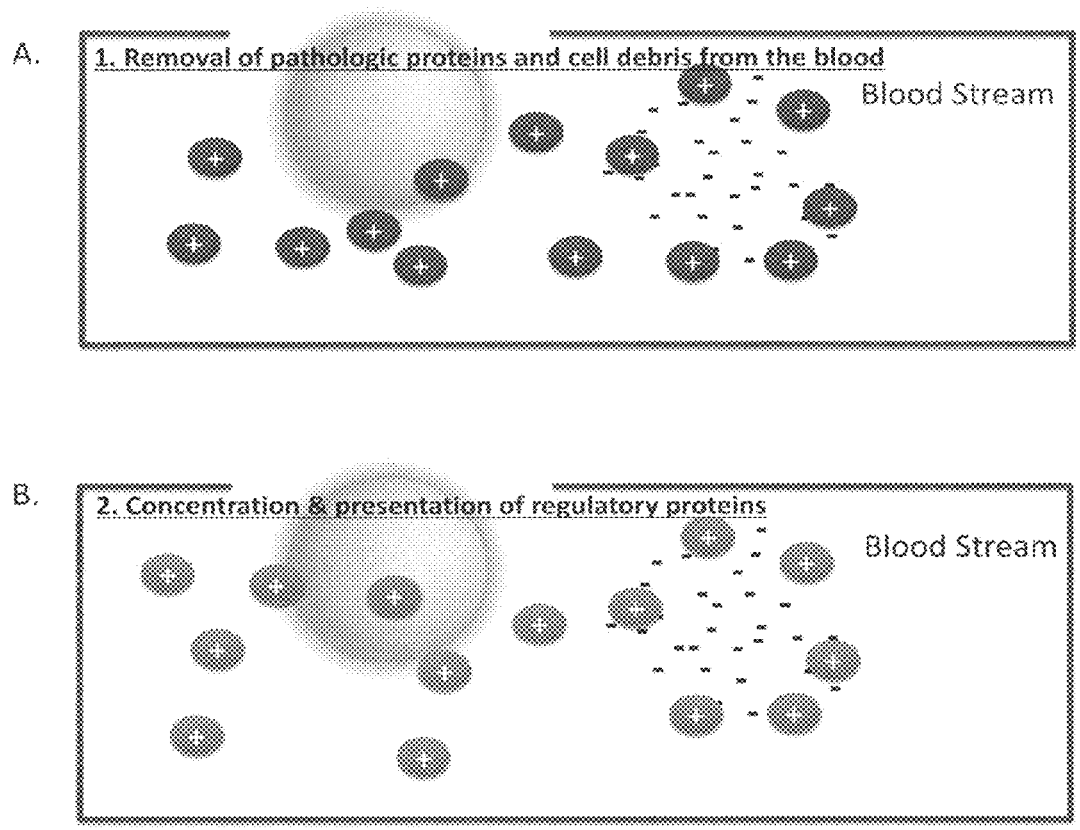

FIG. 16 shows (A) the removal of pathogenic proteins and cellular debris from the blood of a subject with an inflammatory disorder and (B) the concentration and presentation of regulatory proteins from the blood stream of a subject with an inflammatory disorder.

Figure 17:
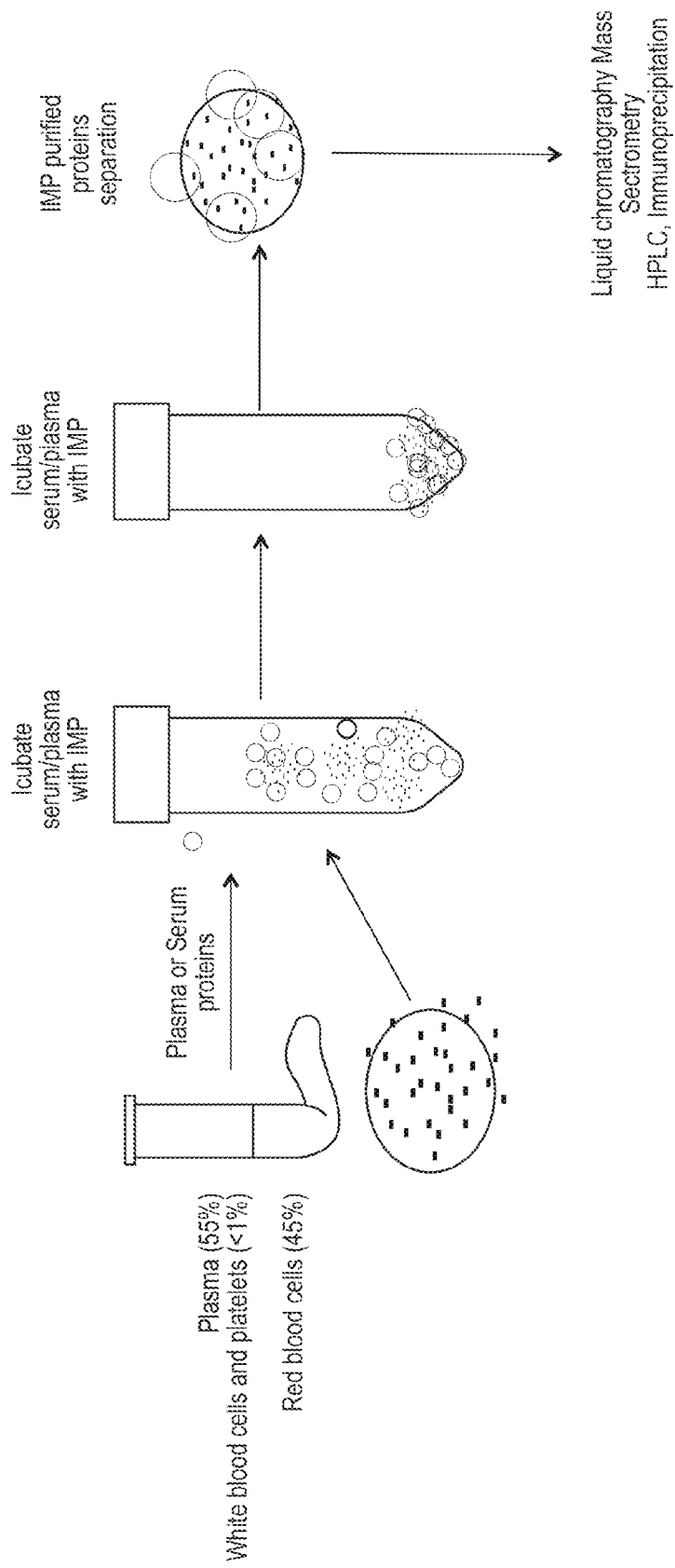

FIG. 17 shows a schematic of negatively charged particles are able to determine the presence or absence of proteins from the serum of a subject in order to determine whether or not the subject is undergoing an inflammatory process.

DETAILED DESCRIPTION OF THE INVENTION

The present inventors have surprisingly found that when negatively charged particles, such as polystyrene, PLGA, or diamond particles of a certain size and zeta potential, are administered to subjects, inflammatory immune responses are ameliorated. Additionally, the present inventors have also surprisingly found that these same negatively charged particles, when administered to subjects, induce monocyte and/or neutrophil apoptosis and improved clearance in the subject. It was also surprising that these same negatively charged particles, when administered to subjects, induce toleragenic dendritic cells, suppressor cells, and regulatory T cells. These negatively charged particles have also been found to remove pro-inflammatory mediators from the inflammatory milieu. Similarly, the negatively charged particles may also concentrate and present regulatory mediators to further induce a regulatory T cell response or otherwise ameliorate the inflammatory immune response. Negatively charged particles, therefore, may be useful in the treatment of any disease or condition characterized by an excessive inflammatory immune response, such as autoimmune diseases, as well as in the treatment of bacterial and viral infections. Finally, particles which have been embedded with one or more antigens induce antigen-specific tolerance in a subject.

"Particle" as used herein refers to any non-tissue derived minute composition of matter, it may be a sphere or sphere-like entity or bead. The term "particle" and the term "bead" may be used interchangeably. Additionally, the term "particle" may be used to encompass beads and spheres.

"Carboxylated particles" or "carboxylated beads" or "carboxylated spheres" includes any particle that has been modified to contain a carboxyl group on its surface. In some embodiments the addition of the carboxyl group enhances phagocyte/monocyte uptake of the particles from circulation, for instance through the interaction with scavenger receptors such as MARCO. The carboxylation can be achieved using any compound which adds carboxyl groups, including, but not limited to poly(ethylene-maleic anhydride) (PEMA).

"Negatively charged particles" or "negatively charged beads" or "negatively charged spheres" include any particle that inherently possesses, or has been modified to have a negative charge. In some embodiments, particles are made to have a negative charge by carboxylation of the particles.

"Antigenic moiety" as used herein refers to any moiety, for example a peptide, that is recognized by the host's immune system. Examples of antigenic moieties include, but are not limited to, autoantigens and/or bacterial or viral proteins, peptides or components. Without being bound by theory, while the negatively charged beads themselves may be recognized by the immune system, the negatively charged beads with nothing more attached thereto are not considered an "antigenic moiety" for the purposes of the invention.

"Naked beads" or "naked particles" or "naked spheres" as used herein refers to beads, particles or spheres that have not been carboxylated or otherwise modified.

"Pro-inflammatory mediators" or "pro-inflammatory polypeptides" as used herein refers to polypeptides or fragments thereof which induce, maintain, or prolong inflammation in a subject. Examples of pro-inflammatory mediators include, but are not limited to, cytokines and chemokines.

"Inflammatory milieu" or "inflammatory foci" as used herein refers to the site of inflammation, or increased concentration of pro-inflammatory mediators, in a subject. The inflammatory milieu may encompass a subjects circulation as a whole. For example, when a subject is suffering from a systemic inflammatory disorder, inflammatory mediators may be found throughout the subject's circulation. Thus, in these embodiments, the inflammatory milieu is not contained within a discreet area.

By "Regulatory T cell" or "Treg" or "Suppressor T cell" is meant a T cell that is capable of modulating the T cell immune response. For example a Treg may be a $CD4^+$ or $CD8^+$ T cell that is capable of inhibiting the effector function of either $CD4^+$ or $CD8^+$ T cell response.

The particle may have any particle shape or conformation. However, in some embodiments it is preferred to use particles that are less likely to clump in vivo. Examples of particles within these embodiments are those that have a spherical shape.

It is not necessary that each particle be uniform in size, although the particles must generally be of a size sufficient to trigger phagocytosis in an antigen presenting cell or other MPS cell. Preferable, the particles are microscopic or nanoscopic in size, in order to enhance solubility, avoid possible complications caused by aggregation in vivo and to facilitate pinocytosis. Particle size can be a factor for uptake from the interstitial space into areas of lymphocyte maturation. A particle having an average diameter of from about 0.1 µm to about 10 µm is capable of triggering phagocytosis. Thus in one embodiment, the particle has a diameter within these limits. In another embodiment, the particle has an average diameter of about 0.2 µm to about 2 µm. In another embodiment, the particle has an average diameter of about 0.3 µm to about 5 µm. In still another embodiment, the particle has an average diameter of about 0.5 µm to about 3 µm. In a further embodiment the particle has an average size of about 0.1 µm, or about 0.2 µm or about 0.3 µm or about 0.4 µm or about 0.5 µm or about 1.0 µm or about 1.5 µm or about 2.0 µm or about 2.5 µm or about 3.0 µm or about 3.5 µm or about 4.0 µm or about 4.5 µm or about 5.0 µm In a particular embodiment the particle has a size of about 0.5 µm. The particles in a composition need not be of uniform diameter. By way of example, a pharmaceutical formulation may contain a plurality of particles, some of which are about 0.5 µm, while others are about 1.0 µm. Any mixture of particle sizes within these given ranges will be useful.

In some embodiments, the particle is non-metallic. In these embodiments the particle may be formed from a polymer. In a preferred embodiment, the particle is biodegradable in an individual. In this embodiment, the particles can provide in an individual across multiple doses without there being an accumulation of particles in the individual. Examples of suitable particles include polystyrene particles, PLGA particles, PLURIONICS stabilized polypropylene sulfide particles, and diamond particles.

Preferably the particle surface is composed of a material that minimizes non-specific or unwanted biological interactions. Interactions between the particle surface and the interstitium may be a factor that plays a role in lymphatic uptake. The particle surface may be coated with a material to prevent or decrease non-specific interactions. Steric stabilization by coating particles with hydrophilic layers such as poly(ethylene glycol) (PEG) and its copolymers such as PLURONICS® (including copolymers of poly(ethylene glycol)-b1-poly(propylene glycol)-b1-poly(ethylene glycol)) may reduce the non-specific interactions with proteins of the interstitium as demonstrated by improved lymphatic uptake following subcutaneous injections. All of these facts point to the significance of the physical properties of the particles in terms of lymphatic uptake. Biodegradable polymers may be used to make all or some of the polymers and/or particles and/or layers. Biodegradable polymers may undergo degradation, for example, by a result of functional groups reacting with the water in the solution. The term "degradation" as used herein refers to becoming soluble, either by reduction of molecular weight or by conversion of hydrophobic groups to hydrophilic groups. Polymers with ester groups are generally subject to spontaneous hydrolysis, e.g., polylactides and polyglycolides.

Particles of the present invention may also contain additional components. For example, carriers may have imaging agents incorporated or conjugated to the carrier. An example of a carrier nanosphere having an imaging agent that is currently commercially available is the Kodak X-sight nanospheres. Inorganic quantum-confined luminescent nanocrystals, known as quantum dots (QDs), have emerged as ideal donors in FRET applications: their high quantum yield and tunable size-dependent Stokes Shifts permit different sizes to emit from blue to infrared when excited at a single ultraviolet wavelength. (Bruchez, et al., Science, 1998, 281, 2013; Niemeyer, C. M Angew. Chem. Int. Ed. 2003, 42, 5796; Waggoner, A. Methods Enzymol. 1995, 246, 362; Brus, L. E. J. Chem. Phys. 1993, 79, 5566). Quantum dots, such as hybrid organic/inorganic quantum dots based on a class of polymers known as dendrimers, may used in biological labeling, imaging, and optical biosensing systems. (Lemon, et al., J. Am. Chem. Soc. 2000, 122, 12886). Unlike the traditional synthesis of inorganic quantum dots, the synthesis of these hybrid quantum dot nanoparticles does not require high temperatures or highly toxic, unstable reagents. (Etienne, et al., Appl. Phys. Lett. 87, 181913, 2005).

Particles can be formed from a wide range of materials. The particle is preferably composed of a material suitable for biological use. For example, particles may be composed of glass, silica, polyesters of hydroxy carboxylic acids, polyanhydrides of dicarboxylic acids, or copolymers of hydroxy carboxylic acids and dicarboxylic acids. More generally, the carrier particles may be composed of polyesters of straight chain or branched, substituted or unsubstituted, saturated or unsaturated, linear or cross-linked, alkanyl, haloalkyl, thioalkyl, aminoalkyl, aryl, aralkyl, alkenyl, aralkenyl, heteroaryl, or alkoxy hydroxy acids, or polyanhydrides of straight chain or branched, substituted or unsubstituted, saturated or unsaturated, linear or cross-linked, alkanyl, haloalkyl, thioalkyl, aminoalkyl, aryl, aralkyl, alkenyl, aralkenyl, heteroaryl, or alkoxy dicarboxylic acids.

Additionally, carrier particles can be quantum dots, or composed of quantum dots, such as quantum dot polystyrene particles (Joumaa et al. (2006) Langmuir 22: 1810-6). Carrier particles including mixtures of ester and anhydride bonds (e.g., copolymers of glycolic and sebacic acid) may also be employed. For example, carrier particles may comprise materials including polyglycolic acid polymers (PGA), polylactic acid polymers (PLA), polysebacic acid polymers (PSA), poly(lactic-co-glycolic) acid copolymers (PLGA), [rho]oly(lactic-co-sebacic) acid copolymers (PLSA), poly(glycolic-co-sebacic) acid copolymers (PGSA), polypropylene sulfide polymers, poly(caprolactone), chitosan, etc. Other biocompatible, biodegradable polymers useful in the present invention include polymers or copolymers of caprolactones, carbonates, amides, amino acids, orthoesters, acetals, cyanoacrylates and degradable urethanes, as well as copolymers of these with straight chain or branched, substituted or unsubstituted, alkanyl, haloalkyl, thioalkyl, aminoalkyl, alkenyl, or aromatic hydroxy- or di-carboxylic acids. In addition, the biologically important amino acids with reactive side chain groups, such as lysine, arginine, aspartic acid, glutamic acid, serine, threonine, tyrosine and cysteine, or their enantiomers, may be included in copolymers with any of the aforementioned materials to provide reactive groups for conjugating to antigen peptides and proteins or conjugating moieties. Biodegradable materials suitable for the present invention include diamond, PLA, PGA, polypropylene sulfide polymers, and PLGA polymers. Biocompatible but non-biodegradable materials may also be used in the carrier particles of the invention. For example, non-biodegradable polymers of acrylates, ethylene-vinyl acetates, acyl substituted cellulose acetates, non-degradable urethanes, styrenes, vinyl chlorides, vinyl fluorides, vinyl imidazoles, chlorosulphonated olefins, ethylene oxide, vinyl alcohols, TEFLON® (DuPont, Wilmington, Del.), and nylons may be employed.

In one embodiment, the buffer solution contacting the immune modified particle may have a basic pH. Suitable basic pH for the basic solution include 7.1, 7.5, 8.0, 8.5, 9.5, 10.0 10.5, 11.0, 11.5, 12.0, 12.5, 13.0, and 13.5. The buffer solution may also be made of any suitable base and its conjugate. In some embodiments of the invention, the buffer solution may include, without limitation, sodium bicarbonate, potassium bicarbonate, lithium bicarbonate, potassium dihydrogen phosphate, sodium dihydrogen phosphate, or lithium dihydrogen phosphate and conjugates thereof.

In one embodiment of the invention, the immune modified particles contain co-polymers. These co-polymers may have varying molar ratio. Suitable co-polymer ratio of present immune modified particles may be 25:75, 30:70, 35:65, 40:60, 45:55, 50:50, 55:45, 60:40, 65:35, 70:30, 75:25, 80:20, 81:19, 82:18, 83:17, 84:16, 85:15, 86:14, 87:13, 88:12, 89:11, 90:10, 91:9, 92:8, 93:7, 94:6, 95:5, 96:4, 97:3, 98:2, 99:1, or 100:0. In another embodiment, the co-polymer may be periodical, statistical, linear, branched (including star, brush, or comb co-polymers) co-polymers. In some embodiments, the co-polymers ratio may be, but not limited to, polystyrene:poly(vinyl carboxylate)/80:20, polystyrene:poly(vinyl carboxylate)/90:10, poly(vinyl carboxylate):polystyrene/80:20, poly(vinyl carboxylate):polystyrene/90:10, polylactic acid:polyglycolic acid/50:50, polylactic acid:polyglycolic acid/80:20, or polylactic acid:polyglycolic acid/90:10.

The particles of the instant invention can be manufactured by any means commonly known in the art. Exemplary methods of manufacturing particles include, but are not limited to, microemulsion polymerization, interfacial polymerization, precipitation polymerization, emulsion evaporation, emulsion diffusion, solvent displacement, and salting out (Astete and Sabliov, J. Biomater. Sci. Polymer Edn., 17:247-289(2006)). Manipulation of the manufacturing process for PLGA particles can control particle properties (e.g. size, size distribution, zeta potential, morphology, hydrophobicity/hydrophilicity, polypeptide entrapment, etc). The size of the particle is influenced by a number of factors including, but not limited to, the concentration of PLGA, the solvent used in the manufacture of the particle, the nature of the organic phase, the surfactants used in manufacturing, the viscosity of the continuous and discontinuous phase, the nature of the solvent used, the temperature of the water used, sonication, evaporation rate, additives, shear stress, sterilization, and the nature of any encapsulated antigen or polypeptide.

Particle size is affected by the polymer concentration; higher particles are formed from higher polymer concentrations. For example, an increase in PLGA concentration from 1% to 4% (w/v) can increase mean particle size from about 205 nm to about 290 nm when the solvent propylene carbonate is used. Alternatively, in ethyl acetate and 5% Pluronic F-127, an increase in PLGA concentration from 1% to 5% (w/v) increases the mean particle size from 120 nm to 230 nm.

The viscosity of the continuous and discontinuous phase is also an important parameter that affects the diffusion process, a key step in forming smaller particles. The size of the particles increases with an increase in viscosity of the dispersed phase, whereas the size of the particles decreases with a more viscous continuous phase. In general, the lower the phase ratio of organic to aqueous solvent, the smaller the particle size.

Homogenizer speed and agitation also affect particle size; in general, higher speeds and agitation cause a decrease in particle size, although there is a point where further increases in speed and agitation no longer decrease particle size. There is a favorable impact in the size reduction when the emulsion is homogenized with a high pressure homogenizer compared with just high stirring. For example, at a phase ration of 20% in 5% PVA, the mean particle size with stirring is 288 nm and the mean particle size with homogenization (high pressure of 300 bars) is 231 nm.

An important size reduction of the particles can be achieved by varying the temperature of the water added to improve the diffusion of the solvent. The mean particle size decreases with an increase in water temperature.

The nature of the polypeptide encapsulated in the particle also affects particle size. In general, encapsulation of hydrophobic polypeptides leads to the formation of smaller particles compared with the encapsulation of more hydrophilic polypeptides. In the double emulsion process, the entrapment of more hydrophilic polypeptides is improved by using high molecular mass PLGA and a high molecular mass of the first surfactant which causes a higher inner phase viscosity. The interaction between the solvent, polymer, and polypeptide affects the efficiency of incorporating the polypeptide into the particle.

The PLGA molecular mass impacts the final mean particle size. In general, the higher the molecular mass, the higher the mean particle size. For example, as the composition and molecular mass of PLGA varies (e.g. 12 to 48 kDa for 50:50 PLGA; 12 to 98 kDa for 75:25 PLGA) the mean particle size varies (about 102 nm –154 nm; about 132 nm to 152 nm respectively). Even when particles are the same molecular mass, their composition can affect average particle size; for example, particles with a 50:50 ratio generally form particles smaller than those with a 75:25 ratio. The end groups on the polymer also affects particle size. For example, particles prepared with ester end-groups form particles with an average size of 740 nm (PI=0.394) compared with the mean size for the acid PLGA end-group is 240 nm (PI=0.225).

The solvent used can also affect particle size; solvents that reduce the surface tension of the solution also reduce particle size.

The organic solvent is removed by evaporation in a vacuum to avoid polymer and polypeptide damage and to promote final particle size reduction. Evaporation of the organic solvent under vacuum is more efficient in forming smaller particles. For example, evaporation in vacuum produces a mean particle size around 30% smaller than the mean particle size produced under a normal rate of evaporation.

The amplitude of the sonication wavelength also affects the particle characteristics. The amplitude of the wavelength should be over 20% with 600 to 800 s of sonication to form sable miniemulsions with no more droplet size changes. However, the main draw-back of sonication is the lack of monodispersity of the emulsion formed.

Organic phases that may be used in the production of the particles of the invention include, but are not limited to, ethyl acetate, methyl ethyl ketone, propylene carbonate, and benzyl alcohol. The continuous phases that may be used, include but are not limited to the surfactant poloxamer 188.

A variety of surfactants can be used in the manufacturing of the particles of the invention. The surfactant can be anionic, cationic, or nonionic. Surfactants in the poloxamer and poloaxamines family are commonly used in particle synthesis. Surfactants that may be used, include, but are not limited to PEG, Tween-80, gelatin, dextran, pluronic L-63, PVA, methylcellulose, lecithin and DMAB. Additionally, biodegradable and biocompatible surfactants including, but not limited to, vitamin E TPGS (D-α-tocopheryl polyethylene glycol 1000 succinate). In certain embodiments, two surfactants are needed (e.g. in the double emulsion evaporation method). These two surfactants can include a hydrophobic surfactant for the first emulsion, and a hydrophobic surfactant for the second emulsion.

Solvents that may be used in the production of the particles of the invention include, but are not limited to, acetone, Tetrahydrofuran (THF), chloroform, and members of the chlorinate family, methyl chloride. The choice of organic solvents require two selection criteria: the polymer must be soluble in this solvent, and the solvent must be completely immiscible with the aqueous phase.

Salts that may be used in the production of the particles of the invention include, but are not limited to magnesium chloride hexahydrate, magnesium acetate tetrahydrate.

Common salting-out agents include, but are not limited to, electrolytes (e.g. sodium chloride, magnesium acetate, magnesium chloride), or non-electrolytes (e.g. sucrose).

The stability and size of the particles of the invention may be improved by the addition of compounds including, but not limited to, fatty acids or short chains of carbons. The addition of the longer carbon chain of lauric acid is associated with the improvement of particle characteristics. Furthermore, the addition of hydrophobic additives can improve the particle size, incorporation of the polypeptide into the particle, and release profile. Preparations of particles can be stabilized by lyophilization. The addition of a cryoprotectant such as trehalose can decrease aggregation of the particles upon lyophilization.

Suitable beads which are currently available commercially include polystyrene beads such as FluoSpheres (Molecular Probes, Eugene, Oreg.).

Physical properties are also related to a nanoparticle's usefulness after uptake and retention in areas having immature lymphocytes. These include mechanical properties such as rigidity or rubberiness. Some embodiments are based on a rubbery core, e.g., a polypropylene sulfide) (PPS) core with an overlayer, e.g., a hydrophilic overlayer, as in PEG, as in the PPS-PEG system recently developed and characterized for systemic (but not targeted or immune) delivery. The rubbery core is in contrast to a substantially rigid core as in a polystyrene or metal nanoparticle system. The term rubbery refers to certain resilient materials besides natural or synthetic rubbers, with rubbery being a term familiar to those in the polymer arts. For example, cross-linked PPS can be used to form a hydrophobic rubbery core. PPS is a polymer that degrades under oxidative conditions to polysulphoxide and finally polysulphone, transitioning from a hydrophobic rubber to a hydrophilic, water-soluble polymer. Other sulphide polymers may be adapted for use, with the term sulphide polymer referring to a polymer with a sulphur in the backbone of the mer. Other rubbery polymers that may be used are polyesters with glass transition temperature under hydrated conditions that is less than about 37° C. A hydrophobic core can be advantageously used with a hydrophilic overlayer since the core and overlayer will tend not to mingle, so that the overlayer tends to sterically expand away from the core. A core refers to a particle that has a layer on it. A layer refers to a material covering at least a portion of the core. A layer may be adsorbed or covalently bound. A particle or core may be solid or hollow. Rubbery hydrophobic cores are advantageous over rigid hydrophobic cores, such as crystalline or glassy (as in the case of polystyrene) cores, in that higher loadings of hydrophobic drugs can be carried by the particles with the rubbery hydrophobic cores.

Another physical property is the surface's hydrophilicity. A hydrophilic material may have a solubility in water of at least 1 gram per liter when it is uncrosslinked. Steric stabilization of particles with hydrophilic polymers can improve uptake from the interstitium by reducing nonspecific interactions; however, the particles' increased stealth nature can also reduce internalization by phagocytic cells in areas having immature lymphocytes. The challenge of balancing these competing features has been met, however, and this application documents the creation of nanoparticles for effective lymphatic delivery to DCs and other APCs in lymph nodes. Some embodiments include a hydrophilic component, e.g., a layer of hydrophilic material. Examples of suitable hydrophilic materials are one or more of polyalkylene oxides, polyethylene oxides, polysaccharides, polyacrylic acids, and polyethers. The molecular weight of polymers in a layer can be adjusted to provide a useful degree of steric hindrance in vivo, e.g., from about 1,000 to about 100,000 or even more; artisans will immediately appreciate that all the ranges and values within the explicitly stated ranges are contemplated, e.g., between 10,000 and 50,000.

The composition of the particles has been found to affect the length of time the particles persist in the body and tolerance requires rapid particle uptake and clearance/degradation. Since ratios of over 50:50 lactide:glycolide slow the degradation rate, the particles of the invention have a lactide:glycolide ratio of about 50:50 or below. In one embodiment the particles of the invention have about a 50:50 D,L-lactide:glycolide ratio.

The particles may incorporate functional groups for further reaction. Functional groups for further reaction include electrophiles or nucleophiles; these are convenient for reacting with other molecules. Examples of nucleophiles are primary amines, thiols, and hydroxyls. Examples of electrophiles are succinimidyl esters, aldehydes, isocyanates, and maleimides.

The efficacy of colloidal therapeutics, such as the negatively charged particles of the present invention, is closely related to the particles' in vivo distribution. The distribution of a colloidal system can be predicted by determining the zeta potential. The zeta potential is measure of the potential difference between the dispersion medium and the stationary layer of fluid attached to the dispersed particle, and indicates the degree of repulsion between adjacent, similarly charged particles in a dispersion. A high zeta potential predicts stability and good dispersion of the colloidal formulation. In preferred embodiments, the zeta potential of the pharmaceutical formulations of the present invention predicts good dispersion of the formulation in vivo.

The particles of the current invention can possess a particular zeta potential. In certain embodiments, the zeta potential is negative. In one embodiment, the zeta potential is less than about −100 mV. In one embodiment, the zeta potential is less than about −50 mV. In certain embodiments, the particles possess a zeta potential between −100 mV and 0 mV. In a further embodiment, the particles possess a zeta potential between −75 mV and 0 mV. In a further embodiment, the particles possess a zeta potential between −60 mV and 0 mV. In a further embodiment, the particles possess a zeta potential between −50 mV and 0 mV. In still a further embodiment, the particles possess a zeta potential between −40 mV and 0 mV. In a further embodiment, the particles possess a zeta potential between −30 mV and 0 mV. In a further embodiment, the particles possess a zeta potential between −20 mV and +0 mV. In a further embodiment, the particles possess a zeta potential between −10 mV and −0 mV. In a further embodiment, the particles possess a zeta potential between −100 mV and −50 mV. In a further embodiment, the particles possess a zeta potential between −75 mV and −50 mV. In a further embodiment, the particles possess a zeta potential between −50 mV and −40 mV.

The particles of the current invention can be given in any dose effective to dampen the inflammatory immune response in a subject in need thereof or to treat a bacterial or viral infection in a subject in need thereof. In certain embodiments, about $10^2$ to about $10^{20}$ particles are provided to the individual. In a further embodiment between about $10^3$ to about $10^{15}$ particles are provided. In yet a further embodiment between about $10^6$ to about $10^{12}$ particles are provided. In still a further embodiment between about $10^8$ to about $10^{10}$ particles are provided. In a preferred embodiment the preferred dose is 0.1% solids/ml. Therefore, for 0.5 μm beads, a preferred dose is approximately $4 \times 10^9$ beads, for 0.05 μm beads, a preferred dose is approximately $4 \times 10^{12}$ beads, for 3 μm beads, a preferred dose is $2 \times 10^7$ beads. However, any dose that is effective in treating the particular condition to be treated is encompassed by the current invention.

The invention is useful for treatment of immune related disorders such as autoimmune disease, transplant rejection, inflammatory diseases and/or disorders, ischemia reperfusion, stroke, myocardial infarction and allergic reactions. Substitution of a synthetic, biocompatible particle system to induce immune tolerance could lead to ease of manufacturing, broad availability of therapeutic agents, increase uniformity between samples, increase the number of potential treatment sites and dramatically reduce the potential for allergic responses to a carrier cell.

As used herein, the term "immune response" includes T cell mediated and/or B cell mediated immune responses. Exemplary immune responses include T cell responses, e.g., cytokine production and cellular cytotoxicity. In addition, the term immune response includes immune responses that are indirectly effected by T cell activation, e.g., antibody production (humoral responses) and activation of cytokine responsive cells, e.g., macrophages. Immune cells involved in the immune response include lymphocytes, such as B cells and T cells ($CD4^+$, $CD8^+$, Th1 and Th2 cells); antigen presenting cells (e.g., professional antigen presenting cells such as dendritic cells, macrophages, B lymphocytes, Langerhans cells, and nonprofessional antigen presenting cells such as keratinocytes, endothelial cells, astrocytes, fibroblasts, oligodendrocytes); natural killer cells; myeloid cells, such as macrophages, eosinophils, mast cells, basophils, and granulocytes. In some embodiments, the modified particles of the present invention are effective to reduce inflammatory cell trafficking to the site of inflammation.

As used herein, the term "inflammatory monocyte" refers to any myeloid cell expressing any combination of CD14/CD16 and CCR2. As used herein, the term "inhibitory neutrophil" encompasses monocyte derived suppressor cells, and/or neutrophils.

As used herein, the term "anergy," "tolerance," or "antigen-specific tolerance" refers to insensitivity of T cells to T cell receptor-mediated stimulation. Such insensitivity is generally antigen-specific and persists after exposure to the antigenic peptide has ceased. For example, anergy in T cells is characterized by lack of cytokine production, e.g., IL-2. T-cell anergy occurs when T cells are exposed to antigen and receive a first signal (a T cell receptor or CD-3 mediated signal) in the absence of a second signal (a costimulatory signal). Under these conditions, re-exposure of the cells to the same antigen (even if re-exposure occurs in the presence of a costimulatory molecule) results in failure to produce cytokines and subsequently failure to proliferate. Thus, a failure to produce cytokines prevents proliferation. Anergic T cells can, however, proliferate if cultured with cytokines (e.g., IL-2). For example, T cell anergy can also be observed by the lack of IL-2 production by T lymphocytes as measured by ELISA or by a proliferation assay using an indicator cell line. Alternatively, a reporter gene construct can be used. For example, anergic T cells fail to initiate DL-2 gene transcription induced by a heterologous promoter under the control of the 5' IL-2 gene enhancer or by a multimer of the API sequence that can be found within the enhancer (Kang et al. 1992 Science. 257:1134).

As used herein, the term "immunological tolerance" refers to methods performed on a proportion of treated subjects in comparison with untreated subjects where: a) a decreased level of a specific immunological response (thought to be mediated at least in part by antigen-specific effector T lymphocytes, B lymphocytes, antibody, or their equivalents); b) a delay in the onset or progression of a specific immunological response; or c) a reduced risk of the onset or progression of a specific immunological response. "Specific" immunological tolerance occurs when immunological tolerance is preferentially invoked against certain antigens in comparison with others. "Non-Specific" immunological tolerance occurs when immunological tolerance is invoked indiscriminately against antigens which lead to an inflammatory immune response. "Quasi-Specific" immunological tolerance occurs when immunological tolerance is invoked semi-discriminately against antigens which lead to a pathogenic immune response but not to others which lead to a protective immune response.

A proxy for tolerogenic activity is the ability of a particle to stimulate the production of an appropriate cytokine at the target site. The immunoregulatory cytokine released by T suppressor cells at the target site is thought to be TGF-β (Miller et al., Proc. Natl. Acad. Sci. USA 89:421, 1992). Other factors that may be produced during tolerance are the cytokines IL4 and IL-10, and the mediator PGE. In contrast, lymphocytes in tissues undergoing active immune destruction secrete cytokines such as IL-I, IL-2, IL-6, and IFNγ. Hence, the efficacy of a modified particle can be evaluated by measuring its ability to stimulate the appropriate type of cytokines.

With this in mind, a rapid screening test for modified particles, effective mucosal binding components, effective combinations, or effective modes and schedules of mucosal administration can be conducted using animal model systems. Animals are treated at a mucosal surface with the test particle composition, and at some time are challenged with administration of the disease causing antigen or an infectious agent. Spleen cells are isolated, and cultured in vitro in the presence of the disease causing antigen or an antigen derived from the infectious gent at a concentration of about 50 μg/mL. Cytokine secretion into the medium can be quantitated by standard immunoassay.

The ability of the particles to suppress the activity of cells can be determined using cells isolated from an animal immunized with the modified particles, or by creating a cell line responsive to a disease causing antigen or viral antigen target antigen (Ben-Nun et al., Eur. J. Immunol. 11:195, 1981). In one variation of this experiment, the suppressor cell population is mildly irradiated (about 1000 to 1250 rads) to prevent proliferation, the suppressors are co-cultured with the responder cells, and then tritiated thymidine incorporation (or MTT) is used to quantitate the proliferative activity of the responders. In another variation, the suppressor cell population and the responder cell population are cultured in the upper and lower levels of a dual chamber transwell culture system (Costar, Cambridge Mass.), which permits the populations to coincubate within 1 mm of each other, separated by a polycarbonate membrane (WO 93/16724). In this approach, irradiation of the suppressor cell population is unnecessary, since the proliferative activity of the responders can be measured separately.

The effectiveness of compositions and modes of administration for treatment of specific disease can also be elaborated in a corresponding animal disease model. The ability of the treatment to diminish or delay the symptomatology of the disease is monitored at the level of circulating biochemical and immunological hallmarks of the disease, immunohistology of the affected tissue, and gross clinical features as appropriate for the model being employed. Non-limiting examples of animal models that can be used for testing are included in the following section.

The invention contemplates modulation of tolerance by modulating TH1 response, TH2 response, TH17 response, or a combination of these responses. Modulating TH1 response encompasses changing expression of, e.g., interferon-gamma. Modulating TH2 response encompasses changing expression of, e.g., any combination of IL-4, IL-5, IL-10, and IL-13. Typically an increase (decrease) in TH2 response will comprise an increase (decrease) in expression of at least one of IL-4, IL-5, IL-10, or IL-13; more typically an increase (decrease) in TH2 response will comprise an increase in expression of at least two of IL-4, IL-5, IL-10, or EL-13, most typically an increase (decrease) in TH2 response will comprise an increase in at least three of DL-4, IL-5, IL-10, or IL-13, while ideally an increase (decrease) in TH2 response will comprise an increase (decrease) in expression of all of IL-4, IL-5, IL-10, and IL-13. Modulating TH17 encompasses changing expression of, e.g., TGF-beta, IL-6, IL-21 and IL23, and effects levels of IL-17, IL-21 and IL-22.

Tolerance to autoantigens and autoimmune disease is achieved by a variety of mechanisms including negative selection of self-reactive T cells in the thymus and mechanisms of peripheral tolerance for those autoreactive T cells that escape thymic deletion and are found in the periphery. Examples of mechanisms that provide peripheral T cell tolerance include "ignorance" of self antigens, anergy or unresponsiveness to autoantigen, cytokine immune deviation, and activation-induced cell death of self-reactive T cells. In addition, regulatory T cells have been shown to be involved in mediating peripheral tolerance. See, for example, Walker et al. (2002) Nat. Rev. Immunol. 2: 11-19; Shevach et al. (2001) Immunol. Rev. 182:58-67. In some situations, peripheral tolerance to an autoantigen is lost (or broken) and an autoimmune response ensues. For example, in an animal model for EAE, activation of antigen presenting cells (APCs) through TLR innate immune receptors was shown to break self-tolerance and result in the induction of EAE (Waldner et al. (2004) J. Clin. Invest. 113:990-997). In certain embodiments, the particles of the current invention are able to induce tolerance or general immune regulation by increasing the frequency and/or effector function of Tregs. The Tregs generally upregulated by the particles of the current invention are $CD4^+CD25^+$ Tregs that also express the transcriptional repressor factor forkhead box P3 (FoxP3). However, the Tregs that are upregulated by the particles of the current invention may also be $CD8^+$ Tregs or suppressor cells.

Accordingly, in some embodiments, the invention provides methods for increasing antigen presentation while suppressing or reducing TLR7/8, TLR9, and/or TLR 7/8/9 dependent cell stimulation. As described herein, administration of particular modified particles results in antigen presentation by DCs or APCs while suppressing the TLR 7/8, TLR9, and/or TLR7/8/9 dependent cell responses associated with immunostimulatory polynucleotides. Such suppression may include decreased levels of one or more TLR-associated cytokines.

In another aspect of the present invention, negatively charged particles act as sink to mop up pro-inflammatory mediators, pathological proteins and cellular debris from the blood of a subject with an inflammatory response as depicted in FIG. 16A. Alternatively, or in addition to, the negatively charged particles of the present invention may concentrate regulatory proteins by binding to regulatory proteins in the blood of a subject with an inflammatory response and present these regulatory proteins to their cognate receptors to further ameliorate an immune response as depicted in FIG. 16B. As discussed in more detail below, the present inventors have found that at least 15 serum proteins are found bound to negatively charged particles in subjects with an active inflammatory immune response that are not found bound to naïve subjects, or subjects where no immune response is ongoing. This is useful not only in the methods described above, wherein the particles can act as a pro-inflammatory sink or as a concentrator/presentor of immunomodulators, but also in the context of diagnostic methods. Specifically, the negatively charged particles of the current invention may be used in broad scale diagnostic methods of blood samples where other methods, such as mass spectrometry and other proteomic methods have failed. It was surprisingly found that when inflammatory plasma or serum was incubated with the negatively charged particles described herein, this resulted in the binding and subsequent purification of proteins not found in the serum/plasma under non-inflammatory or homeostatic conditions.

In another aspect of the present invention, particles encompassing antigens are provided. Nanoparticles carrying antigen on their surface have been successfully used to induce T-cell tolerance (Getts et al., 2012 Nature Biotechnology 30:1217-1223). Tolerance induced by peptide-coupled particles depends on both the induction of T-cell anergy and the activity of regulatory T cells and may represent an alternative way to treat autoimmune disorders by inducing T-cell tolerance. This T-cell tolerance was observed when using peptides couple to biodegradable (PLG) particles.

In one embodiment, the particles of the invention are coupled to antigens comprising one or more epitopes associated with allergies, autoimmune diseases and/or inflammatory diseases or disorders. The antigens may comprise one or more copies of an epitope. In one embodiment, the antigens comprise a single epitope associated with one disease or disorder. In a further embodiment, the antigens comprise more than one epitope associated with the same disease or disorder. In yet a further embodiment, the antigens comprise more than one epitope associated with different diseases or disorders. In a further embodiment, the antigens comprise one or more epitopes associated with one or more allergies. In a further embodiment, the antigens comprise one or more epitopes associated with multiple sclerosis, type 1 diabetes. Celiac's disease, and/or inflammatory bowel disease, including Crohn's disease or ulcerative colitis.

In one embodiment, the epitopes are from myelin basic protein (e.g. SEQ ID NOs:4975 & 4976), proteolipid protein (e.g. SEQ ID NO: 4977), myelin oligodendrocyte glycoprotein (e.g. SEQ ID NOs: 1 & 4978), an aquaporin, (e.g. SEQ ID NO: 4979), myelin associated glycoprotein (e.g. SEQ ID NO: 4980), insulin (e.g. SEQ ID NO: 4981), glutamic acid decarboxylase (e.g. SEQ ID NO: 4982), gliadin (e.g. SEQ ID NOs:4983-4985, or 5136-5140), or the α3 chain of type IV collagen (e.g. SEQ ID NO: 5017), or fragments, homologs, or isoforms thereof. In a further embodiment, the epitopes are from gluten, including from gliadin and/or glutenin. In one embodiment, the epitopes are from insulin homologs, such as those described in U.S. Pat. No. 8,476,228 hereby incorporated in its entirety for all purposes. In one embodiment, the gliaden epitopes are SEQ ID NOs: 13, 14, 16, 320, or 321 in U.S. Application No. 20110293644, or those described in Sollid et al. (2012) Immunogenetics 65:455-460, both hereby incorporated in its entirety for all purposes.

Further non-limiting examples of epitopes associated with various autoimmune diseases and/or inflammatory diseases or disorders that are contemplated by the instant invention are described in Tables 1 and 2.

TABLE 1

Representative Linear Epitopes

| Disease | Representative Epitopes |
|---|---|
| Multiple Sclerosis | SEQ ID NOs: 2-1294 |
| Celiac Disease | SEQ ID NOs: 1295-1724; |
|  | SEQ ID NOs: 1726-1766; |
|  | SEQ ID NOs: 4986-5140 |
| Diabetes | SEQ ID NOs: 1767-1840; |
|  | SEQ ID NOs: 1842-1962; |
|  | SEQ ID NOs: 1964-2027; |
|  | SEQ ID NOs: 2029-2073; |
|  | SEQ ID NOs: 2075-2113; |
|  | SEQ ID NOs: 2115-2197; |
|  | SEQ ID NOs: 2199-2248; |
|  | SEQ ID NOs: 2250-2259; |
|  | SEQ ID NOs: 2261-2420; |
|  | SEQ ID NOs: 2422-2486; |
|  | SEQ ID NOs: 2489-2505 |
| Rheumatoid Arthritis | SEQ ID NOs: 2506-3260; |
|  | SEQ ID NOs: 3262-3693 |
| Systemic Lupus Erythematosus | SEQ ID NOs: 3694-3857; |
|  | SEQ ID NOs: 3860-4565 |
| Good Pasture's Syndrome | SEQ ID NOs: 4566-4576; |
|  | SEQ ID NOs: 4578-4610; |
|  | SEQ ID NOs: 4612-4613; |
|  | SEQ ID NOs: 5018-5039 |
| Autoimmune Uveitis | SEQ ID NOs: 4614-4653 |
| Autoimmune Thyroiditis | SEQ ID NOs: 4654-4694; |
|  | SEQ ID NOs: 4696-4894; |
|  | SEQ ID NOs: 4896-4901 |
| Autoimmune Myositis | SEQ ID NOs: 4902-4906 |
| Autoimmune Vasculitis | SEQ ID NOs: 4907-4914 |
| Autoimmune Pancreatitis | SEQ ID NOs: 4915-4917 |
| Crohns Disease | SEQ ID NOs: 4918-4941 |
| Ulcerative Colitis | SEQ ID NOs: 4942-4952 |
| Psoriasis | SEQ ID NOs: 4953-4963 |
| Reactive Arthritis | SEQ ID NOs: 4964-4974 |

Not all epitopes are linear epitopes; epitopes can also be discontinuous, conformational epitopes. A number of discontinuous epitopes associated with autoimmune diseases or inflammatory diseases and/or disorders are known. Non-limiting examples of discontinuous epitopes are described in Table 2.

TABLE 2

Representative Discontinuous Epitopes

| Disease | Epitope | Full Length Polypeptide |
|---|---|---|
| Celiac Disease | D151, E153, E154, E155, E158; | Protein-glutamine gamma-glutamyltransferase 2 |
|  | D306, N308, N310; | SEQ ID NO: 1725 |
|  | D434, E435, E437, D438; |  |
|  | E329; |  |
|  | E153; |  |
|  | R19, E153, M659; or |  |
|  | C277, H335, D358 |  |
| Diabetes | E517; | Glutamate decarboxylase 2 |
|  | R255, F256, K257, K263, | SEQ ID NOs: 1841, 1963, |

TABLE 2-continued

Representative Discontinuous Epitopes

| Disease | Epitope | Full Length Polypeptide |
|---|---|---|
| | E264, K265, L270, P271, R272, L273, L285, K286, K287, I294, G295, T296, D297, S298, R317, R318; N483, I484, I485, K486, N487, R488, E489, G490, Y491, E492, M493, V494, F495, D496, G497, K498, P499, F556, F557, R558, M559, V560, I561, S562, N563, P564, A565, A566, T567, H568, Q569, D570, I571, D572, F573, L574, I575, E576, E577, I578, E579, R580, L581, G582, Q583, D584, L585; E264; E517, E520, E521, S524, S527, V532; E517, E521; K358; R536, Y540 | 2114, & 2249 |
| Diabetes | P876, A877, E878, T880; T804; T804, V813, D821, R822, Q862, P886; T804, V813, D821, R822, Q862, P886; W799, E836, N858; D911; Q862; L831, H833, V834, E836, Q860; W799, E836, N858; W799, L831, H833, V834, Y835, E836, Q860; | protein tyrosine phosphatase, receptor type, N precursor SEQ ID NOs: 2028 & 2074 |
| Diabetes | R325, R332, E333, K336, K340; R325; W325 | zinc transporter 8 isoform a SEQ ID NO: 2421 |
| Diabetes | E872, C945 | Receptor-type tyrosine-protein phosphatase N2 SEQ ID NOs: 2198, 2260, & 2487 |
| Diabetes | W799, C909 | tyrosine phosphatase SEQ ID NO: 2488 |
| Rheumatoid Arthritis | L14, M15, I16, S17, R18, N147, G148, S187, M191, H196, N197, H198, Y199, Q201, S203 | Chain A, Crystal Structure Of A Human Igm Rheumatoid Factor Fab In Complex With Its Autoantigen Igg Fc SEQ ID NO: 3261 |
| Systemic Lupus Erythematosus | K591, S592, G593 | ATP-dependent DNA helicase 2 subunit 1 SEQ ID NO: 3858 |
| Systemic Lupus Erythematosus | M1, K2, L3, V4, R5, F6, L7, M8, K9, L10, S11, H12, E13, T14, V15, T16, I17, E18, L19, K20, N21, G22, T23, Q24, V25, H26, P85, K86, V87, K88, S89, K90, K91, R92, E93, A94, V95, A96, G97, R98, G99, R100, G101, R102, G103, R104, G105, R106, G107, R108, G109, R110, G111, R112, G113, R114, G115, G116, P117, R118, R119 | Small nuclear ribonucleoprotein Sm D1 SEQ ID NO: 3859 |
| Systemic Lupus Erythematosus | G59, R62 | beta-2-glycoprotein I SEQ ID NO: 4357 |
| Good Pasture's Syndrome | T24, A25, I26, S28, E31, V34, P35, S38, Q64 | type IV collagen alpha3 chain SEQ ID NO: 4577 |
| Good Pasture's Syndrome | T1455, A1456, I1457, S1459, E1462, T1464, V1465, P1466, Y1468, S1469, Q1495, T1537, T1565, P1569, H1572, K1579, A1634 | alpha3 type IV collagen SEQ ID NO: 4611 |
| Autoimmune Thyroiditis | E604, D620, K627, D630; R225, R646, D707; K627; | Thyroid peroxidase SEQ ID NO: 4695 |

TABLE 2-continued

Representative Discontinuous Epitopes

| Disease | Epitope | Full Length Polypeptide |
|---|---|---|
| Autoimmune Thyroiditis | R225;<br>Y772;<br>K713, F714, P715, E716;<br>P715, D717<br>D36, R38, K42, Q55, K58, I60,<br>E61, R80, Y82, S84, T104,<br>H105, E107, R109, N110, K129,<br>F130, D151, F153, I155, E157,<br>T181, K183, D203 | Thyrotropin receptor<br>SEQ ID NO: 4895 |

In another aspect of the present invention, particles encapsulating antigens are provided. Particles which encapsulate antigens inside the particle can be used to induce T-cell tolerance in a subject. Examples of antigens which can be encapsulated within the particles of the invention include, but are not limited to, exogenous antigens, such as viral and bacterial antigens, endogenous antigens, autoantigens, tumor antigens, and/or native antigens.

Monocytes and macrophages play central roles in the initiation and resolution of inflammation, principally through phagocytosis, the release of inflammatory cytokines, reactive oxygen species and the activation of the acquired immune system (Auffray et al., 2009 Annu Rev Immunol 27:669-692). Typically, monocytes circulate in the bloodstream for a very short time before undergoing apoptosis, however, stimulatory signals can trigger monocyte survival by inhibiting the apoptotic pathway, and thus contribute to the maintenance of the inflammatory response. Anti-apoptotic proteins work by inhibiting caspases or the activation of the apoptotic program. Phosphatidyl inositol 3-kinase (PI-3K)/Akt, ERK, Fas, TNF, heat shock proteins and anti-apoptotic molecules, among others, play key roles in determining monocyte life span. During the inflammatory response, inflammatory cells, such as monocytes and macrophages, are recruited to the sites of inflammation. This recruitment is essential for effective control and clearance of infection, but recruited monocytes also contribute to the pathogenesis of inflammatory and degenerative diseases. The accumulation of monocytes can be harmful and aggravate disease such as atherosclerosis, arthritis, and multiple sclerosis. Resolution of inflammation requires the reduction and/or inhibition of inflammatory cells to the inflammatory foci, and apoptosis of the inflammatory cells already present. Apoptotic caspases play a fundamental role by proteolytically dismantling cells by degrading proteins with diverse biological functions. For instance, caspase-3 activation is essential for CD14$^+$ monocyte apoptosis (Fahy et al., 1999 J. Immunol. 163:1755-1762).

The negatively charged particles of the present invention (sometimes referred to herein as "immune modified particles" or "IMPs") specifically inhibit inflammatory monocyte immigration into inflammatory foci. Inflammatory monocytes take up IMPs in a macrophage receptor with collagenous (MARCO) dependent fashion and migrate to the spleen, whereby they undergo caspase 3-mediated cell death. Importantly IMP therapy is shown to have positive impacts on West Nile Virus (WNV) encephalitis, peritonitis, experimental autoimmune encephalomyelitis, heart function after myocardial infarction, kidney reperfusion injury and colitis. IMPs provide an alternative and highly specific tool for inhibiting inflammatory monocytes in a MARCO-dependent manner. Harnessing a natural leukocyte clearance pathway, IMPs represent a novel and safe inflammatory monocyte specific therapy.

In one aspect, the methods of the current invention include inducing apoptosis in monocytes, granulocytes and/or neutrophils in a subject to reduce the severity or duration of an inflammatory response. In one embodiment, administering the negatively charged particles of the invention induces monocyte, granulocyte and/or neutrophil apoptosis and clearance, thereby aiding in the resolution of inflammation.

In one aspect, the methods of the current invention contemplate using the particles of the invention as "molecular sinks" that bind to inflammatory molecules and polypeptides produced by the cell, thereby preventing them from exerting their activity. When inflammation happens, pro-inflammatory mediators such as cytokines and chemokines are released by cells, such as macrophages and monocytes, into the surrounding pro-inflammatory milieu. Examples of pro-inflammatory mediators include, but are not limited to interleukins, members of the TNF family, interferons, and colony stimulating factors. These mediators potentiate the inflammatory response, thereby exacerbating the inflammatory pathology. As described herein, the particles of the invention bind to inflammatory mediators in the serum of animals experiencing an inflammatory immune response. The inflammatory mediators to which the particles of the invention bind include, but are not limited to, heat shock protein beta −1, protein S100-A7, protein S100-A8, protein S100-A9, fatty acid-binding protein, annexin A1 and ubiquitin cross-reactive protein precursor. Administration of uncoated particles of the invention to animals results in a decrease of inflammatory monocytes present in the inflammatory foci, a decrease in inflammatory symptoms, and an increase in survival of infected animals.

As discussed above, this invention provides novel compounds that have biological properties useful for the treatment of immune mediated disorders.

Accordingly, in another aspect of the present invention, pharmaceutical compositions are provided, which comprise the particles and optionally comprise a pharmaceutically acceptable carrier. In certain embodiments, these compositions optionally further comprise one or more additional therapeutic agents. In another embodiment, the particles of the invention may encapsulate an antigen or be embedded with an antigen. Alternatively, the particles of the current invention may be administered to a patient in need thereof in combination with the administration of one or more other therapeutic agents. For example, additional therapeutic agents for conjoint administration or inclusion in a pharmaceutical composition with a compound of this invention may be an approved anti-inflammatory agent, or it may be any one of a number of agents undergoing approval in the Food and Drug Administration that ultimately obtain approval for the treatment of any disorder characterized by an uncontrolled inflammatory immune response or a bacterial or viral infection. It will also be appreciated that certain of the modified particles of present invention can exist in free form for treatment, or where appropriate, as a pharmaceutically acceptable derivative thereof.

The pharmaceutical compositions of the present invention additionally comprise a pharmaceutically acceptable carrier, which, as used herein, includes any and all solvents, diluents, or other liquid vehicle, dispersion or suspension aids, surface active agents, isotonic agents, thickening or emulsifying agents, preservatives, solid binders, lubricants and the like, as suited to the particular dosage form desired. Remington's Pharmaceutical Sciences, Sixteenth Edition, E. W. Martin (Mack Publishing Co., Easton, Pa., 1980) discloses various carriers used in formulating pharmaceutical compositions and known techniques for the preparation thereof. Except insofar as any conventional carrier medium is incompatible with the compounds of the invention, such as by producing any undesirable biological effect or otherwise interacting in a deleterious manner with any other component(s) of the pharmaceutical composition, its use is contemplated to be within the scope of this invention. Some examples of materials which can serve as pharmaceutically acceptable carriers include, but are not limited to, sugars such as lactose, glucose and sucrose; starches such as corn starch and potato starch; cellulose and its derivatives such as sodium carboxymethyl cellulose, ethyl cellulose and cellulose acetate; powdered tragacanth; malt; gelatine; talc; excipients such as cocoa butter and suppository waxes; oils such as peanut oil, cottonseed oil; safflower oil, sesame oil; olive oil; corn oil and soybean oil; glycols; such as propylene glycol; esters such as ethyl oleate and ethyl laurate; agar; buffering agents such as magnesium hydroxide and aluminum hydroxide; alginic acid; pyrogenfree water; isotonic saline; Ringer's solution; ethyl alcohol, and phosphate buffer solutions, as well as other non-toxic compatible lubricants such as sodium lauryl sulfate and magnesium stearate, as well as coloring agents, releasing agents, coating agents, sweetening, flavoring and perfuming agents, preservatives and antioxidants can also be present in the composition, according to the judgment of the formulator.

Liquid dosage forms for oral administration include, but are not limited to, pharmaceutically acceptable emulsions, microemulsions, solutions, suspensions, syrups and elixirs. In addition to the active compounds, the liquid dosage forms may contain inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, the oral compositions can also include adjuvants such as wetting agents, emulsifying and suspending agents, sweetening, flavoring, and perfuming agents.

Injectable preparations, for example, sterile injectable aqueous or oleaginous suspensions may be formulated according to the known art using suitable dispersing or wetting agents and suspending agents. The sterile injectable preparation may also be a sterile injectable solution, suspension or emulsion in a nontoxic parenterally acceptable diluent or solvent, for example, as a solution in 1,3-butanediol. Among the acceptable vehicles and solvents that may be employed are water, Ringer's solution, U.S.P. and isotonic sodium chloride solution. In addition, sterile, fixed oils are conventionally employed as a solvent or suspending medium. For this purpose any bland fixed oil can be employed including synthetic mono- or diglycerides. In addition, fatty acids such as oleic acid are used in the preparation of injectables.

The injectable formulations can be sterilized, for example, by filtration through a bacterial-retaining filter, or by incorporating sterilizing agents in the form of sterile solid compositions which can be dissolved or dispersed in sterile water or other sterile injectable medium prior to use.

In order to prolong the effect of a drug, it is often desirable to slow the absorption of the drug from subcutaneous or intramuscular injection. This may be accomplished by the use of a liquid suspension or crystalline or amorphous material with poor water solubility. The rate of absorption of the drug then depends upon its rate of dissolution that, in turn, may depend upon crystal size and crystalline form. Alternatively, delayed absorption of a parenterally administered drug form is accomplished by dissolving or suspending the drug in an oil vehicle. Injectable depot forms are made by forming microencapsule matrices of the drug in biodegradable polymers such as polylactide-polyglycolide. Depending upon the ratio of drug to polymer and the nature of the particular polymer employed, the rate of drug release can be controlled. Examples of other biodegradable polymers include (poly(orthoesters) and poly(anhydrides). Depot injectable formulations are also prepared by entrapping the drug in liposomes or microemulsions which are compatible with body tissues. In certain embodiments, drugs and therapeutics may be encapsulated in the particles of the invention for administration to the subject.

Solid dosage forms for oral administration include capsules, tablets, pills, powders, and granules. In such solid dosage forms, the modified particles are mixed with at least one inert, pharmaceutically acceptable excipient or carrier such as sodium citrate or dicalcium phosphate and/or a) fillers or extenders such as starches, lactose, sucrose, glucose, mannitol, and silicic acid, b) binders such as, for example, carboxymethylcellulose, alginates, gelatin, polyvinylpyrrolidinone, sucrose, and acacia, c) humectants such as glycerol, d) disintegrating agents such as agar-agar, calcium carbonate, potato or tapioca starch, alginic acid, certain silicates, and sodium carbonate, e) solution retarding agents such as paraffin, f) absorption accelerators such as quaternary ammonium compounds, g) wetting agents such as, for example, cetyl alcohol and glycerol monostearate, h) absorbents such as kaolin and bentonite clay, and i) lubricants such as talc, calcium stearate, magnesium stearate, solid polyethylene glycols, sodium lauryl sulfate, and mixtures thereof. In the case of capsules, tablets and pills, the dosage form may also comprise buffering agents.

Solid compositions of a similar type may also be employed as fillers in soft and hard-filled gelatin capsules using such excipients as lactose or milk sugar as well as high molecular weight polyethylene glycols and the like. The solid dosage forms of tablets, dragees, capsules, pills, and granules can be prepared with coatings and shells such as enteric coatings and other coatings well known in the pharmaceutical formulating art. They may optionally contain opacifying agents and can also be of a composition that they release the active ingredient(s) only, or preferentially, in a certain part of the intestinal tract, optionally, in a delayed manner. Examples of embedding compositions that can be used include polymeric substances and waxes. Solid compositions of a similar type may also be employed as fillers in soft and hard-filled gelatin capsules using such excipients as lactose or milk sugar as well as high molecular weight polyethylene glycols and the like.

The modified particles can also be in micro-encapsulated form with one or more excipients as noted above. The solid dosage forms of tablets, dragees, capsules, pills, and granules can be prepared with coatings and shells such as enteric coatings, release controlling coatings and other coatings well known in the pharmaceutical formulating art. In such solid dosage forms the active compound may be admixed with at least one inert diluent such as sucrose, lactose and starch. Such dosage forms may also comprise, as in normal practice, additional substances other than inert diluents, e.g., tableting lubricants and other tableting aids such as magnesium stearate and microcrystalline cellulose. In the case of capsules, tablets and pills, the dosage forms may also comprise buffering agents. They may optionally contain opacifying agents and can also be of a composition that they release the modified particles only, or preferentially, in a certain part of the intestinal tract, optionally, in a delayed manner. Examples of embedding compositions which can be used include polymeric substances and waxes.

The present invention encompasses pharmaceutically acceptable topical formulations of the inventive modified particles. The term "pharmaceutically acceptable topical formulation", as used herein, means any formulation which is pharmaceutically acceptable for intradermal administration of modified particles of the invention by application of the formulation to the epidermis. In certain embodiments of the invention, the topical formulation comprises a carrier system. Pharmaceutically effective carriers include, but are not limited to, solvents (e.g., alcohols, poly alcohols, water), creams, lotions, ointments, oils, plasters, liposomes, powders, emulsions, microemulsions, and buffered solutions (e.g., hypotonic or buffered saline) or any other carrier known in the art for topically administering pharmaceuticals. A more complete listing of art-known carriers is provided by reference texts that are standard in the art, for example, Remington's Pharmaceutical Sciences, 16th Edition, 1980 and 17th Edition, 1985, both published by Mack Publishing Company, Easton, Pa., the disclosures of which are incorporated herein by reference in their entireties. In certain other embodiments, the topical formulations of the invention may comprise excipients. Any pharmaceutically acceptable excipient known in the art may be used to prepare the inventive pharmaceutically acceptable topical formulations. Examples of excipients that can be included in the topical formulations of the invention include, but are not limited to, preservatives, antioxidants, moisturizers, emollients, buffering agents, solubilizing agents, other penetration agents, skin protectants, surfactants, and propellants, and/or additional therapeutic agents used in combination to the modified particles. Suitable preservatives include, but are not limited to, alcohols, quaternary amines, organic acids, parabens, and phenols. Suitable antioxidants include, but are not limited to, ascorbic acid and its esters, sodium bisulfite, butylated hydroxytoluene, butylated hydroxyanisole, tocopherols, and chelating agents like EDTA and citric acid. Suitable moisturizers include, but are not limited to, glycerine, sorbitol, polyethylene glycols, urea, and propylene glycol. Suitable buffering agents for use with the invention include, but are not limited to, citric, hydrochloric, and lactic acid buffers. Suitable solubilizing agents include, but are not limited to, quaternary ammonium chlorides, cyclodextrins, benzyl benzoate, lecithin, and polysorbates. Suitable skin protectants that can be used in the topical formulations of the invention include, but are not limited to, vitamin E oil, allatoin, dimethicone, glycerin, petrolatum, and zinc oxide.

In certain embodiments, the pharmaceutically acceptable topical formulations of the invention comprise at least the modified particles of the invention and a penetration enhancing agent. The choice of topical formulation will depend or several factors, including the condition to be treated, the physicochemical characteristics of the inventive compound and other excipients present, their stability in the formulation, available manufacturing equipment, and costs constraints. As used herein the term "penetration enhancing agent" means an agent capable of transporting a pharmacologically active compound through the stratum corneum and into the epidermis or dermis, preferably, with little or no systemic absorption. A wide variety of compounds have been evaluated as to their effectiveness in enhancing the rate of penetration of drugs through the skin. See, for example, Percutaneous Penetration Enhancers, Maibach H. I. and Smith H. E. (eds.), CRC Press, Inc., Boca Raton, Fla. (1995), which surveys the use and testing of various skin penetration enhancers, and Buyuktimkin et al., Chemical Means of Transdermal Drug Permeation Enhancement in Transdermal and Topical Drug Delivery Systems, Gosh T. K., Pfister W. R., Yum S. I. (Eds.), Interpharm Press Inc., Buffalo Grove, Ill. (1997). In certain exemplary embodiments, penetration agents for use with the invention include, but are not limited to, triglycerides (e.g., soybean oil), aloe compositions (e.g., aloe-vera gel), ethyl alcohol, isopropyl alcohol, octolyphenylpolyethylene glycol, oleic acid, polyethylene glycol 400, propylene glycol, N-decylmethylsulfoxide, fatty acid esters (e.g., isopropyl myristate, methyl laurate, glycerol monooleate, and propylene glycol monooleate) and N-methylpyrrolidone.

In certain embodiments, the compositions may be in the form of ointments, pastes, creams, lotions, gels, powders, solutions, sprays, inhalants or patches. In certain exemplary embodiments, formulations of the compositions according to the invention are creams, which may further contain saturated or unsaturated fatty acids such as stearic acid, palmitic acid, oleic acid, palmito-oleic acid, cetyl or oleyl alcohols, stearic acid being particularly preferred. Creams of the invention may also contain a non-ionic surfactant, for example, polyoxy-40-stearate. In certain embodiments, the active component is admixed under sterile conditions with a pharmaceutically acceptable carrier and any needed preservatives or buffers as may be required. Ophthalmic formulation, eardrops, and eye drops are also contemplated as being within the scope of this invention. Additionally, the present invention contemplates the use of transdermal patches, which have the added advantage of providing controlled delivery of a compound to the body. Such dosage forms are made by dissolving or dispensing the compound in the proper medium. As discussed above, penetration enhancing agents can also be used to increase the flux of the compound across the skin. The rate can be controlled by either providing a rate controlling membrane or by dispersing the compound in a polymer matrix or gel.

The modified particles can be administered by aerosol. This is accomplished by preparing an aqueous aerosol, liposomal preparation or solid particles containing the modified particles. A nonaqueous (e.g., fluorocarbon propellant) suspension could be used.

Ordinarily, an aqueous aerosol is made by formulating an aqueous solution or suspension of the agent together with conventional pharmaceutically acceptable carriers and stabilizers. The carriers and stabilizers vary with the requirements of the particular compound, but typically include nonionic surfactants (Tweens, Pluronics®, or polyethylene glycol), innocuous proteins like serum albumin, sorbitan esters, oleic acid, lecithin, amino acids such as glycine, buffers, salts, sugars or sugar alcohols. Aerosols generally are prepared from isotonic solutions.

It will also be appreciated that the modified particles and pharmaceutical compositions of the present invention can be formulated and employed in combination therapies, that is, the compounds and pharmaceutical compositions can be formulated with or administered concurrently with, prior to, or subsequent to, one or more other desired therapeutics or medical procedures. The particular combination of therapies (therapeutics or procedures) to employ in a combination regimen will take into account compatibility of the desired therapeutics and/or procedures and the desired therapeutic effect to be achieved. It will also be appreciated that the therapies employed may achieve a desired effect for the same disorder (for example, an inventive compound may be administered concurrently with another anti-inflammatory agent), or they may achieve different effects (e.g., control of any adverse effects).

In certain embodiments, the pharmaceutical compositions containing the modified particles of the present invention further comprise one or more additional therapeutically active ingredients (e.g., anti-inflammatory and/or palliative). For purposes of the invention, the term "Palliative" refers to treatment that is focused on the relief of symptoms of a disease and/or side effects of a therapeutic regimen, but is not curative. For example, palliative treatment encompasses painkillers, antinausea medications and anti-sickness drugs.

The invention provides methods of regulating an immune response in an individual, preferably a mammal, more preferably a human, comprising administering to the individual the modified particles described herein. Methods of immunoregulation provided by the invention include those that suppress and/or inhibit an innate immune response or an adaptive immune response, including, but not limited to, an immune response stimulated by immunostimulatory polypeptides or viral or bacterial components.

The modified particles are administered in an amount sufficient to regulate an immune response. As described herein, regulation of an immune response may be humoral and/or cellular, and is measured using standard techniques in the art and as described herein.

In certain embodiments, the individual suffers from a disorder associated with unwanted immune activation, such as allergic disease or condition, allergy and asthma. An individual having an allergic disease or asthma is an individual with a recognizable symptom of an existing allergic disease or asthma.

In certain embodiments, the individual suffers from a disorder associated with unwanted immune activation, such as autoimmune disease and inflammatory disease. An individual having an autoimmune disease or inflammatory disease is an individual with a recognizable symptom of an existing autoimmune disease or inflammatory disease.

Autoimmune diseases can be divided in two broad categories: organ-specific and systemic. Autoimmune diseases include, without limitation, rheumatoid arthritis (RA), systemic lupus erythematosus (SLE), type I diabetes mellitus, type II diabetes mellitus, multiple sclerosis (MS), immune-mediated infertility such as premature ovarian failure, scleroderma, Sjogren's disease, vitiligo, alopecia (baldness), polyglandular failure, Grave's disease, hypothyroidism, polymyositis, *pemphigus vulgaris, pemphigus foliaceus,* inflammatory bowel disease including Crohn's disease and ulcerative colitis, Celiac disease, autoimmune hepatitis including that associated with hepatitis B virus (HBV) and hepatitis C virus (HCV), hypopituitarism, graft-versus-host disease (GvHD), myocarditis, Addison's disease, autoimmune skin diseases, uveitis, pernicious anemia, and hypoparathyroidism.

Autoimmune diseases may also include, without limitation, Amyotrophic Lateral Sclerosis (ALS), Hashimoto's thyroiditis, Type I and Type II autoimmune polyglandular syndromes, paraneoplastic pemphigus, bullus pemphigoid, dermatitis herpetiformis, linear IgA disease, epidermolysis bullosa acquisita, erythema nodosa, pemphigoid gestationis, cicatricial pemphigoid, mixed essential cryoglobulinemia, chronic bullous disease of childhood, hemolytic anemia, thrombocytopenic purpura, Goodpasture's syndrome, autoimmune neutropenia, myasthenia gravis, Eaton-Lambert myasthenic syndrome, stiff-man syndrome, acute disseminated encephalomyelitis, Guillain-Barre syndrome, chronic inflammatory demyelinating polyradiculoneuropathy, multifocal motor neuropathy with conduction block, chronic neuropathy with monoclonal gammopathy, opsonoclonus-myoclonus syndrome, cerebellar degeneration, encephalomyelitis, retinopathy, primary biliary sclerosis, sclerosing cholangitis, gluten-sensitive enteropathy, ankylosing spondylitis, reactive arthritis, polymyositis/dermatomyositis, mixed connective tissue disease, Bechet's syndrome, psoriasis, polyarteritis nodosa, allergic anguitis and granulomatosis (Churg-Strauss disease), polyangiitis overlap syndrome, hypersensitivity vasculitis, Wegener's granulomatosis, temporal arteritis, Takayasu's arteritis, Kawasaki's disease, isolated vasculitis of the central nervous system, thromboangiutis obliterans, sarcoidosis, glomerulonephritis, and cryopathies. These conditions are well known in the medical arts and are described, for example, in Harrison's Principles of Internal Medicine, 14th ed., Fauci A S et al., eds., New York: McGraw-Hill, 1998.

Subjects treated by the particles of the present invention are preferably human, however, the particles are useful in treating non-human animal species. Non-human animal species which may be treated by the particles of the present invention include, but are not limited to, dogs, cats, chickens, geese, ducks, sheep, cows, goats, pigs, non-human primates, monkey, rabbits, mice, rats, guinea pigs, hamsters, gerbils, and horses.

Animal models for the study of autoimmune disease are known in the art. For example, animal models which appear most similar to human autoimmune disease include animal strains which spontaneously develop a high incidence of the particular disease. Examples of such models include, but are not limited to, the non-obese diabetic (NOD) mouse, which develops a disease similar to type 1 diabetes, and lupus-like disease prone animals, such as New Zealand hybrid, MRL-$Fas^{lpr}$ and BXSB mice. Animal models in which an autoimmune disease has been induced include, but are not limited to, experimental autoimmune encephalomyelitis (EAE), which is a model for multiple sclerosis, collagen-induced arthritis (CIA), which is a model for rheumatoid arthritis, and experimental autoimmune uveitis (EAU), which is a model for uveitis. Animal models for autoimmune disease have also been created by genetic manipulation and include, for example, IL-2/IL-10 knockout mice for inflammatory bowel disease, Fas or Fas ligand knockout for SLE, and IL-I receptor antagonist knockout for rheumatoid arthritis.

In certain embodiments, the individual suffers from a bacterial or viral infection. An individual having a bacterial or viral infection is an individual with a recognizable symptom of an existing bacterial or viral infection.

A non-limiting list of viral infections treatable with the modified particles of the current invention includes herpes virus infections, hepatitis virus infections, west nile virus infections, flavivirus infections, influenza virus infections, rhinovirus infections, papillomavirus infections, paromyxovirus infections, parainfluenza virus infections, and retrovirus infections. Preferred viruses are those viruses that infect the central nervous system of the subject. Most preferred viruses are those that cause encephalitis or meningitis.

A non-limiting list of bacterial infections treatable with the modified particles of the current invention include *staphylococcus* infections, *streptococcus* infections, mycobacterial infections, *bacillus* infections, *Salmonella* infections, *Vibrio* infections, spirochete infections, and *Neisseria* infections. Preferred are bacteria that infect the central nervous system of the subject. Most preferred are bacteria that cause encephalitis or meningitis.

In some embodiments, the invention relates to uses of compositions of this invention prior to the onset of disease. In other embodiments, the invention relates to uses of the compositions of this invention to inhibit ongoing disease. In some embodiments, the invention relates to ameliorating disease in a subject. By ameliorating disease in a subject is meant to include treating, preventing or suppressing the disease in the subject.

In some embodiments, the invention relates to preventing the relapse of disease. For example, an unwanted immune response can occur at one region of a peptide (such as an antigenic determinant). Relapse of a disease associated with an unwanted immune response can occur by having an immune response attack at a different region of the peptide. Since the negatively charged particles of the current invention are free from attached peptides or antigenic moieties, the particles will be effective against multiple epitopes. T-cell responses in some immune response disorders, including MS and other ThI/17-mediated autoimmune diseases, can be dynamic and evolve during the course of relapsing-remitting and/or chronic-progressive disease. The dynamic nature of the T-cell repertoire has implications for treatment of certain diseases, since the target may change as the disease progresses. Previously, pre-existing knowledge of the pattern of responses was necessary to predict the progression of disease. The present invention provides compositions that can prevent the effect of dynamic changing disease, a function of "epitope spreading." A known model for relapse is an immune reaction to proteolipid protein (PLP) as a model for multiple sclerosis (MS). Initial immune response can occur by a response to PLP139-15. Subsequent disease onset can occur by a relapse immune response to PLP[pi]s-iβi.

Certain embodiments of this invention relate to treatment of pathological conditions relating to an unwanted hypersensitivity. The hypersensitivity can be any one of types I, II, III, and IV. Immediate (type I) hypersensitivity. The frequency of administration will typically correspond with the timing of allergen exposure. Suitable animal models are known in the art (for example, Gundel et al., Am. Rev. Respir. Dis. 146:369, 1992, Wada et al., J. Med. Chem. 39, 2055, 1996; and WO 96/35418).

Other embodiments of this invention relate to transplantation. This refers to the transfer of a tissue sample or graft from a donor individual to a recipient individual, and is frequently performed on human recipients who need the tissue in order to restore a physiological function provided by the tissue. Tissues that are transplanted include (but are not limited to) whole organs such as kidney, liver, heart, lung; organ components such as skin grafts and the cornea of the eye; and cell suspensions such as bone marrow cells and cultures of cells selected and expanded from bone marrow or circulating blood, and whole blood transfusions.

A serious potential complication of any transplantation ensues from antigenic differences between the host recipient and the engrafted tissue. Depending on the nature and degree of the difference, there may be a risk of an immunological assault of the graft by the host, or of the host by the graft, or both, may occur. The extent of the risk is determined by following the response pattern in a population of similarly treated subjects with a similar phenotype, and correlating the various possible contributing factors according to well accepted clinical procedures. The immunological assault may be the result of a preexisting immunological response (such as preformed antibody), or one that is initiated about the time of transplantation (such as the generation of TH cells). Antibody, TH cells, or Tc cells may be involved in any combination with each other and with various effector molecules and cells. However, the antigens which are involved in the immune response are generally not known, therefore posing difficulties in designing antigen-specific therapies or inducing antigen-specific tolerance. The modified particles of the current invention are particularly useful in preventing the rejection of organs because no attached peptides or antigens need to be conjugated to the modified particles in order for the particles to be effective in inducing tolerance or ameliorate an inflammatory immune response.

Certain embodiments of the invention relate to decreasing the risk of host versus graft disease, leading to rejection of the tissue graft by the recipient. The treatment may be performed to prevent or reduce the effect of a hyperacute, acute, or chronic rejection response. Treatment is preferentially initiated sufficiently far in advance of the transplant so that tolerance will be in place when the graft is installed; but where this is not possible, treatment can be initiated simultaneously with or following the transplant. Regardless of the time of initiation, treatment will generally continue at regular intervals for at least the first month following transplant. Follow-up doses may not be required if a sufficient accommodation of the graft occurs, but can be resumed if there is any evidence of rejection or inflammation of the graft. Of course, the tolerization procedures of this invention may be combined with other forms of immunosuppression to achieve an even lower level of risk.

Certain embodiments of the invention relate to decreasing or otherwise ameliorating the inflammatory response induced as a response to surgery. In one embodiment of the invention, the immune-modifying particles are administered before surgery. In a further embodiment of the invention, the immune-modifying particles are administered concurrently with or during surgery. In yet a further embodiment of the invention, the immune-modifying particles are administered after surgery.

The particles of the invention may also be used to treat abscesses or empyemas to decrease the inflammatory response produced in the subject after exposure to infectious agents such as bacteria or parasites. In one embodiment of the invention, the immune-modifying particles are administered in conjunction with anti-bacterial and/or anti-parasitic treatments known in the art.

The particles of the invention may also be used to decrease or otherwise ameliorate the inflammatory response induced as a response to physical trauma or injury including, but not limited to, a sports injury, a wound, a spinal cord injury, a brain injury, and/or a soft tissue injury. In one embodiment of the invention, the immune-modifying particles are administered after the subject experiences trauma or injury.

The particles of the invention may also be used to decrease the inflammatory response associated with the development and/or growth of cancer cells. Cancers that can be treated include, but are not limited to, central nervous system cancer, basal cell carcinoma, cancerous brain tumors, Burkitt's lymphoma, lymphoma, cervical cancer, ovarian cancer, testicular cancer, liver cancer, non-small cell and small cell lung cancers, melanoma, bladder cancer, breast cancer, colon and rectal cancers, endometrial cancer, kidney (renal cell) cancer, leukemia, Non-Hodgkin lymphoma, pancreatic cancer, prostate cancer, and thyroid cancer. In one embodiment, the subcutaneous injection of the particles of the invention prevents the accumulation of inhibitory neutrophils or monocyte derived suppressor cells, thereby enhancing or facilitating the tumor-specific immune response the cancer patient.

The particles of the invention are also useful for the regeneration of damaged tissue. In one embodiment, administration of the particles to a patient increases the regeneration of damaged epithelial cells in the digestive tract. In a further embodiment, the patient suffers from ulcerative colitis, Crohn's disease, or inflammatory bowel disease. In another embodiment, administration of the particles of the invention to a patient increases remyelination of neurons. In a further embodiment, the patient suffers from multiple sclerosis.

EXAMPLES

The following examples are provided to further illustrate the advantages and features of the invention, but are not intended to limit the scope of this disclosure.

Materials and Methods

Mice

For WNV and IBD studies, eight-week old female C57BL/6 mice were obtained from the Animal Resources Centre (WA, Australia). All procedures were performed with permission of the University of Sydney Animal Ethics Committee. For EAE studies, eight-week old female SJL/J mice were obtained from Harlan Laboratories (Indianapolis, Ind., USA). For thioglycollate studies, eight-week old female Balb/c were obtained from the National Cancer Institute (MD, USA). MARCO-/- animals on the Balb/c background were kindly provided by Lester Kobzik (Harvard University, MA, USA). For cardiac inflammation studies, twelve-week old male C57BL/6 mice were purchased from the Jackson Laboratory (ME, USA). All procedures were performed with permission of the Northwestern University Institutional Animal Care and Use Committee. All animals were housed under specific pathogen-free conditions with food and water provided ad libitum.

WNV Infection

WNV (Sarafend) was derived from the brains of neonatal mice and propagated in vitro cell cultures (Getts et al., J. Exp Med. 205:2319-2337, 2008). WNV infection was conducted in C57BL/6 animals (Getts et al., J. Exp Med. 205:2319-2337, 2008). Mice were intranasally infected with 6×104 or 6×103 PFU WNV in 104, sterile Phosphate buffered saline (PBS; Invitrogen, CA, USA). Mock 24 infections were conducted using sterile PBS only. Following infection, mice were weighed daily.

Thioglycollate-Induced Peritonitis

The induction of peritonitis was performed intraperitoneal injection of 1 ml of a 4% (w/v) Thioglycollate broth prepared in sterile water (Sigma Aldrich, MO, USA). Leukocytes were isolated at defined time points by intraperitoneal lavage (wash) using ice cold 0.05 mM EDTA PBS solution.

EAE Induction

PLP139-151 (HSLGKWLGHPDKF) peptide-induced EAE was induced in SJL/J mice (Getts et al., J. Immunol. 187:2405-2417, 2011). Individual animals were observed daily and clinical scores were assessed in a blinded fashion on a 0-5 scale as follows: 0=no abnormality; 1=limp tail or hind limb weakness; 2=limp tail and hind limb weakness; 3=hind limb paralysis; 4=hind limp paralysis and forelimb weakness; and 5=moribund. These data are reported as the mean clinical score. Paralysed animals were afforded easier access to food and water.

Cardiac Infarction

Myocardial infarction was conducted in C57BL/6 mice. The left anterior descending artery was permanently occluded surgically (Yeap et al., Methods in Molecular Biology, In Press).

Kidney Ischemia Reperfusion Induction

The renal artery was ligated for 45 minutes and then released to allow complete reperfusion of the kidney.

Inflammatory Bowel Disease Induction

The DSS-induced colitis model of IBD was induced (Bao et al., Immunol. Cell Bio. 89:853-860, 2011). Dextran sulphate sodium (DSS, MW 36,000-44,000 D; ICN Biomedicals, Australasia) 2.5% w/v 25 dissolved in tap water was administered ad libitum for 9 consecutive days 41. Control groups received tap water only during this time. Bodyweight and clinical assessments were measured daily. Percentage bodyweight loss was calculated as follows: (mean weight at (day 0-9)/weight on day 0)×100. Following bodyweight measurements, mice were examined for clinical parameters, including mobility and gait, vocalizations, group interactions & grooming. Each parameter was scored a value between 0-2, where a total value of 0-1 represents normal, 2-4 mild, 5-7 moderate, 8-10 severe41. Faecal assessment was measured daily where possible. Scores were given for faecal consistency, hematochezia, and rectal bleeding. A total value between 0-6 reflected the faecal score, where a value of 0 represents faeces of normal appearance and a value of 6 represents severe diarrhea, rectal bleeding and presence of blood in stools.

Intravenous Delivery of Particles

FITC or Bright Blue (BB) Flouresbrite plain and carboxylated polystyrene particles (0.5 μm diameter) were obtained from Polysciences (PA, USA). FITC Poly(lactic-coglycolic acid) (PLGA) and FITC polystyrene plain, carboxylated and aminated particles (500 nm diameter) were obtained from Phosphorex (MA, USA). Carboxylated 500 nm nanodiamonds were generated at Macquarie University or Sydney University (NSW, Australia). Particles were diluted to the indicated concentration in sterile PBS and 200 μL, was injected i.v. as indicated. Vehicle control animals received 200 μL, sterile PBS only. Tissues were harvested at the designated time points and process for flow cytometry, histology, or immunohistochemistry. Isolation and sorting of bone marrow-derived Ly6C$^{hi}$ inflammatory monocytes was performed as described in Getts et al., 2008, with isolated cells labeled with PKH26 (Invitrogen) and 2.0×10$^6$ cells injected i.v. into mock- and WNV-infected recipients on D6 p.i. Specific particle properties are defined in Table 3.

Flow Cytometry

Mice were anesthetized and perfused with 50 mL sterile PBS. Spleen, brain, bone marrow, blood and peritoneal fluid was isolated and processed into single cell suspensions (Getts et al., J. Exp Med. 205:2319-2337, 2008). Cells were incubated with anti-CD16/32 and live cells were counted using trypan blue exclusion, which routinely showed >95% viability. Cells were then incubated with fluorescently-labelled antibodies against CD45, CD11b, Ly6C, Ly6G, CD11c, CD103, ETC (Biolegend). Cell surface molecule expression was measured on a FACS LSR-II using FACS Diva program (Becton Dickinson, NJ, USA). Viable populations were gated by forward- and side-scatter and identified fluorescent populations determined by forward-gating thereafter. Acquired FACS data files were analyzed using the flow cytometry program Flow Jo (Tree Star, Inc. OR, USA). Quantification of cell populations of interest were calculated based on flow cytometry percentages at analysis and absolute cell counts from each organ.

Adoptive Transfer

The bone marrow of WNV-infected animals was processed into single cell suspensions on D6 p.i. and incubated with fluorescently-labelled antibodies against CD11b, Ly6C and Ly6G. CD11b+, Ly6Chi, Ly6G-monocytes were sorted on a FACS Aria using the FACS Diva program (Becton Dickinson), with stringencies set to achieve 98% purity. Cells were then labeled with the fluorescent membrane dye PKH26 (Invitrogen) according to the manufacturer's instructions. Matched mock-infected and WNV-infected recipients were i.v. injected with 2.0×106 sorted Ly6Chi monocytes on D6 p.i., delivered in 200 µL PBS. Brain and spleens were isolated from recipients on D7 p.i. (24 h post-transfer) and processed for flow cytometry, as described above.

Histology and Immunohistochemistry

Mice were anesthetized and perfused with 50 mL sterile PBS. With the exception of the heart, which were processed into paraffin blocks (Getts et al., J. Neurochem 103:10919-1030, 2007), all organs were isolated and snap frozen in Optimum Cutting Temperature Compound (OCT; Tissue-Tek, Tokyo, Japan). Eight-micron tissue sections were cut on a cryostat microtome, air-dried overnight and then stored at −80° C. until required. Frozen sections were thawed and histology (standard haematoxylin and eosin staining) or immunohistochemistry was performed (Getts et al., J. Exp Med 205:2319-2337, 2008). Antibodies against MARCO, SIGN-R1 and SIGLEC-1 (R&D Systems, MN, USA), CD68 (Abcam, MA, USA) and Ki67 (Abcam), were used as indicated. Images were acquired on an Olympus BX-51 microscope using a DP-70 camera and DP manager 2.2.1 software (Olympus, Tokyo, Japan).

Histology and Immunohistochemistry

Mice were anesthetized and perfused with 50 mL sterile PBS. With the exception of the heart, which were processed into paraffin blocks (Getts et al., J. Neurochem 103:10919-1030, 2007), all organs were isolated and snap frozen in Optimum Cutting Temperature Compound (OCT; Tissue-Tek, Tokyo, Japan). Eight-micron tissue sections were cut on a cryostat microtome, air-dried overnight and then stored at −80° C. until required. Frozen sections were thawed and histology (standard haematoxylin and eosin staining) or immunohistochemistry was performed (Getts et al., J. Exp Med 205:2319-2337, 2008). Antibodies against MARCO, SIGN-R1 and SIGLEC-1 (R&D Systems, MN, USA), CD68 (Abcam, MA, USA) and Ki67 (Abcam), were used as indicated. Images were acquired on an Olympus BX-51 microscope using a DP-70 camera and DP manager 2.2.1 software (Olympus, Tokyo, Japan).

Multiplex ELISA

Multiplex plate ELISA (Quansys Biosciences) was performed using the Quansys Q-plex Mouse Cytokine Screen IR 16-plex according to the manufacturer's instructions. Plates were visualized on the Li-Cor Odyssey IR Imaging System (Li-Cor Biotechnology). Images were analysed using Quansys Q-view software (Quansys Biosciences).

TABLE 3

Physical Properties of the Particles
Physical Properties

| Chemical Formula | Immune Modified (Carboxylated) Polystyrene Particles (Phosphorex) | Polystyrene Neutral Particles (Phosphorex) | Polystyrene Positive Charged (Aminated Particles-Phosphorex) | Immune Modified Nano-Diamonds (University of Sydney) | Immune Modified (Carboxylated) PLGA Particles (Phosphorex) |
|---|---|---|---|---|---|
| Color | white latex | white latex | white latex | Milky white (solution) | White powder (lyophilized) |
| Odor | None | None | None | None | None |
| Melting point/° C. | 240° C. | 240° C. | 240° C. | 4500 K | N/A (amorphous) |
| Glass Transition/° C. | 100° C. | 100° C. | 100° C. | N/A | 40-55° C. |
| Solubility | Insoluble in water or alcohols, soluble in acetone, ethyl acetate, THF, DMF, toluene, methylene chloride, etc. | Insoluble in water or alcohols, soluble in acetone, ethyl acetate, THF, DMF, toluene, methylene chloride, etc. | Insoluble in water or alcohols, soluble in acetone, ethyl acetate, THF, DMF, toluene, methylene chloride, etc. | N/A | Insoluble in water, soluble in acetone, ethyl acetate, DMSO, DMF, acetonitrile, chloroform, methylene chloride, etc. |
| Copolymer ratio (mol %) | 90:10 | 100:0 | 90:10 | N/A | 50:50 |
| Melt Index g/10 Minutes, 200° C./5 kg | 6.0-9.0 | 6.0-9.0 | 6.0-9.0 | N/A | N/A |
| MW (kDa) | 10-250 | 10-250 | 10-250 | 22,000,000 KD | 5-50 |
| Residual monomer | unknown | unknown | unknown | N/A | <0.5% lactide <0.5% glycolide |
| Sn content (ppm) | N/A | N/A | N/A | N/A | <100 (ICP) |

TABLE 3-continued

Physical Properties of the Particles
Physical Properties

| Chemical Formula | Immune Modified (Carboxylated) Polystyrene Particles (Phosphorex) | Polystyrene Neutral Particles (Phosphorex) | Polystyrene Positive Charged (Aminated Particles-Phosphorex) | Immune Modified Nano-Diamonds (University of Sydney) | Immune Modified (Carboxylated) PLGA Particles (Phosphorex) |
|---|---|---|---|---|---|
| Heavy metals (ppm) | unknown | unknown | unknown | 0-0.55% Nickel 0-0.50 Copper prior to carboxylation by acid washing | <10 |
| Sulphate Ash (%) | unknown | unknown | unknown | N/A | <0.1 |
| Size distribution | 10.4% | 2.4% | 10.4% | 270 ± 30 nm | 10-50% |
| Zeta Potential | −40~−50 mv | −5~+5 mv | +20~+40 mv | −50.6 +/− 3 mV | −30~−50 mV |

Statistics

Graphs were made and statistical analyses were performed in GraphPad Prism (GraphPad software, SDG, USA). To compare two samples an unpaired two-tailed Student t-test was conducted. To compare three or more samples, a one-way ANOVA with a Tukey-Kramer post-test was performed. For survival data, the Mantel-Haenszel logrank test was conducted. For these tests, $P \leq 0.05$ (*) was deemed significant, and $P \leq 0.01$ (**) very significant.

Example 1

Opsonized IMPs have Reduced Ability to Inhibit Macrophage Migration to the Brain Day 7 plasma was taken from mock or WNV infected animals and incubated with PS-IMP. These "opsonized" particles or un-opsonized (untreated beads) particles were re-infused into WNV infected mice at day 6 p.i. On day 7 the brains were examined for inflammatory monocyte influx by flow cytometry. While untreated (Normal IMP) resulted in a reduced monocyte influx into the brain, mock plasma coated IMP had no ability to inhibit monocyte migration (FIG. 9). WNV serum coated IMPs had a reduced ability to inhibit monocytes relative to uncoated IMP, but were still capable of reducing migration to some degree.

Example 2

Figure 1B:
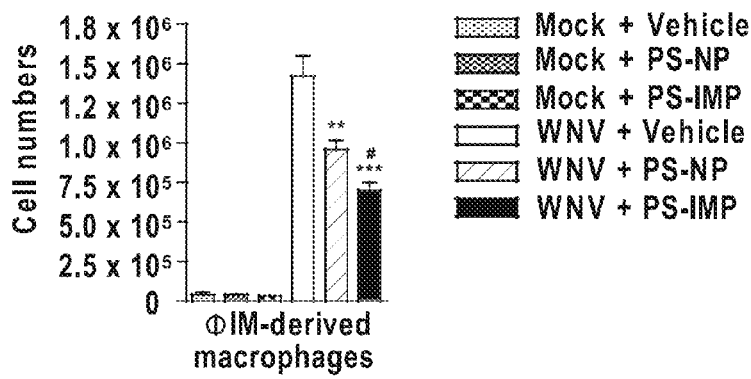

Immune-Modifying Particles Reduce Inflammatory Monocyte Migration and Increase WNV Survival A hallmark of acute and many chronic inflammatory diseases is the influx of monocytes into the area of inflammation. Previously, we have shown that morbidity associated with WNV brain infection is the direct result of inflammatory monocyte trafficking into the brain (Getts, 2008; Getts, 2007; Terry, 2012; Getts, 2012). In this model, weight loss of ≥5% is a biomarker that correlates with ΦIM trafficking into the brain and thus lethality (Getts et al., J. Neuroinflammation, In Press). At least 50% of infected animals will go on to lose weight, of which 100% will typically succumb to infection, within 72 hours of initial weight loss (FIG. 1A). Animals that do not lose weight do not show any other symptoms of encephalitis but still develop life long sterilizing immunity (FIG. 1A). To monitor monocyte trafficking, carboxylated, negatively charged polystyrene particles (PS-IMP) were unintentionally infused instead of polystyrene neutral particles (PS-NP) at initial weight loss (day 6). Surprisingly, infusion almost immediately reduced symptoms such as ruffled fur, malaise and seizures, uniformly associated with clinical WNV central nervous system (CNS) infection. This reduction correlated with a reduction in local pro-inflammatory cytokines and chemokines (FIG. 6). Furthermore, daily infusion of PS-IMP for up to 5 days resulted in 60% survival of mice that would otherwise have succumbed to infection (FIG. 1A). In these mice, body weight typically stabilized and returned to control levels within 5-6 days (not shown). PS-NP- or vehicle-treated mice showed continued weight loss, with ≤10% survival. Furthermore, pre-opsonisation of IMP before infusion, with serum from WNV or mock infected animals, had no impact on disease outcome (not shown). Consistent with our previous observations in WNV encephalitis (Getts, 2008; Getts, 2007; Terry, 2012; Getts, 2012), survival correlated with a significant reduction in ΦIM-derived macrophages in the brains of PS-IMP-treated mice, compared to phosphate buffered saline (vehicle)-treated, or PS-NP-treated control animals (FIG. 1B, FIG. 7).

Example 3

The Immune-Modifying Particles Must be Negatively Charged

Figure 1C:
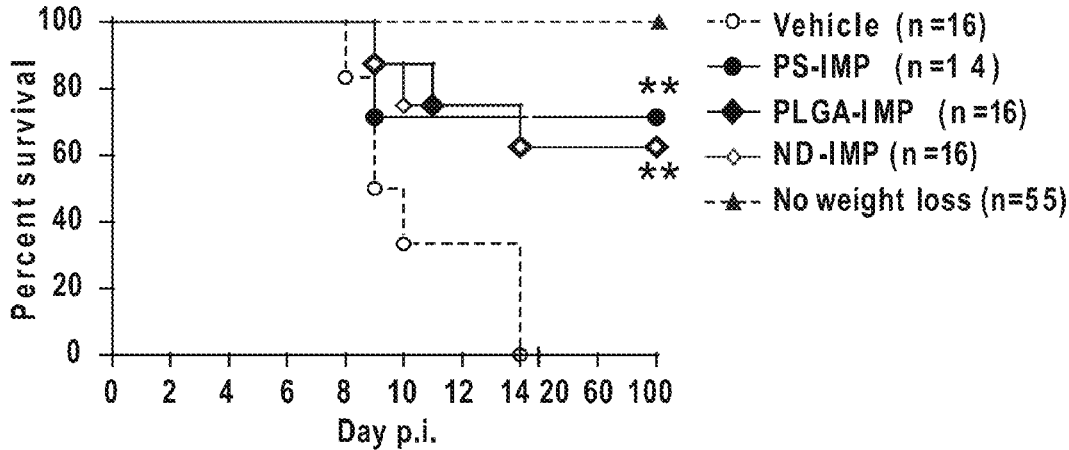
Figure 1D:
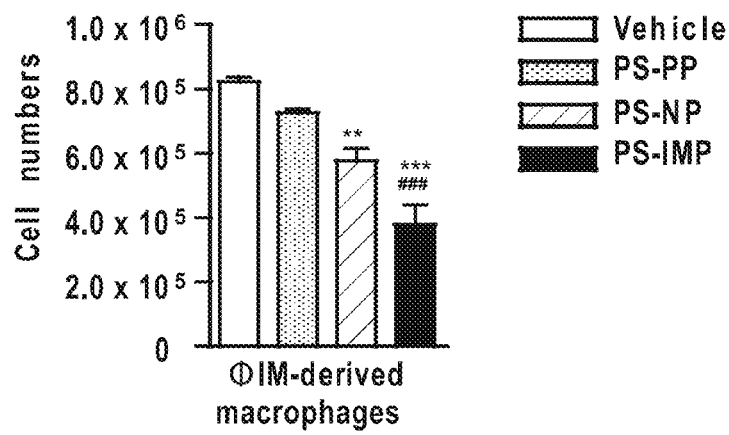
Figure 1E:
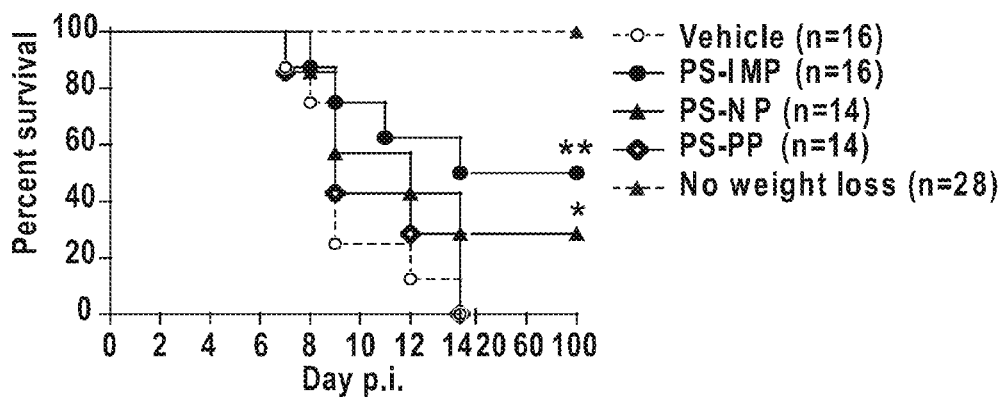
Figure 1F:
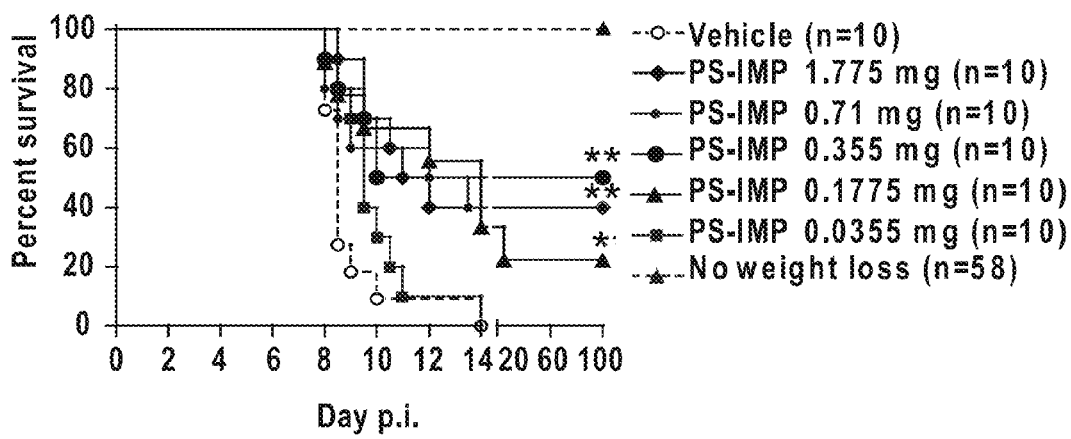
Figure 1G:
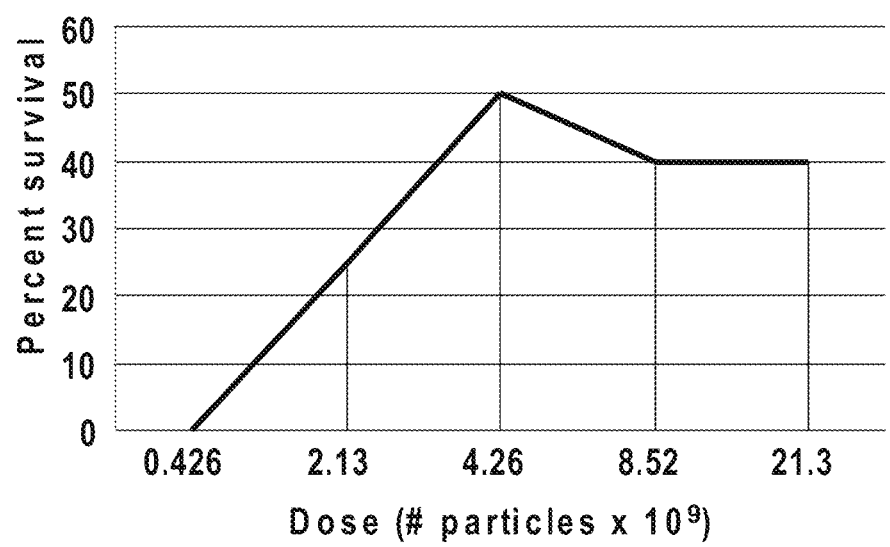

Treatment of WNV-infected animals with other carboxylated particles, specifically ND IMP, and PLGA-IMP, resulted in survival statistics similar to those seen in animals treated with PS-IMP (FIG. 1C), indicating that particle core is independent of the property responsible for the therapeutic effect. Initial pilot studies used carboxylated PS-IMP, with a zeta potential of less than −50 mV (Table 3). We thus compared PS particles with zeta potentials of −50 mV, ~−0.5 (neutral; Polystyrene Neutral Particles; PS-NP) or +40 mV (aminated particles, polystyrene-positive particles; PS-PP). PS-IMP (−50 mV) showed the greatest impact in regards to reduced inflammatory monocyte trafficking to the brain (FIG. 1D). In contrast, PP did not decrease infiltration of IM-derived macrophages (FIG. 1D), nor increase survival (FIG. 1E). The dose response for 500 nm PS-IMP in mice with WNV encephalitis showed the most effective dose to be ~4×109 IMP particles or 0.355 mg of particles per mouse (FIG. 1F-G).

Example 4

Figure 2A:
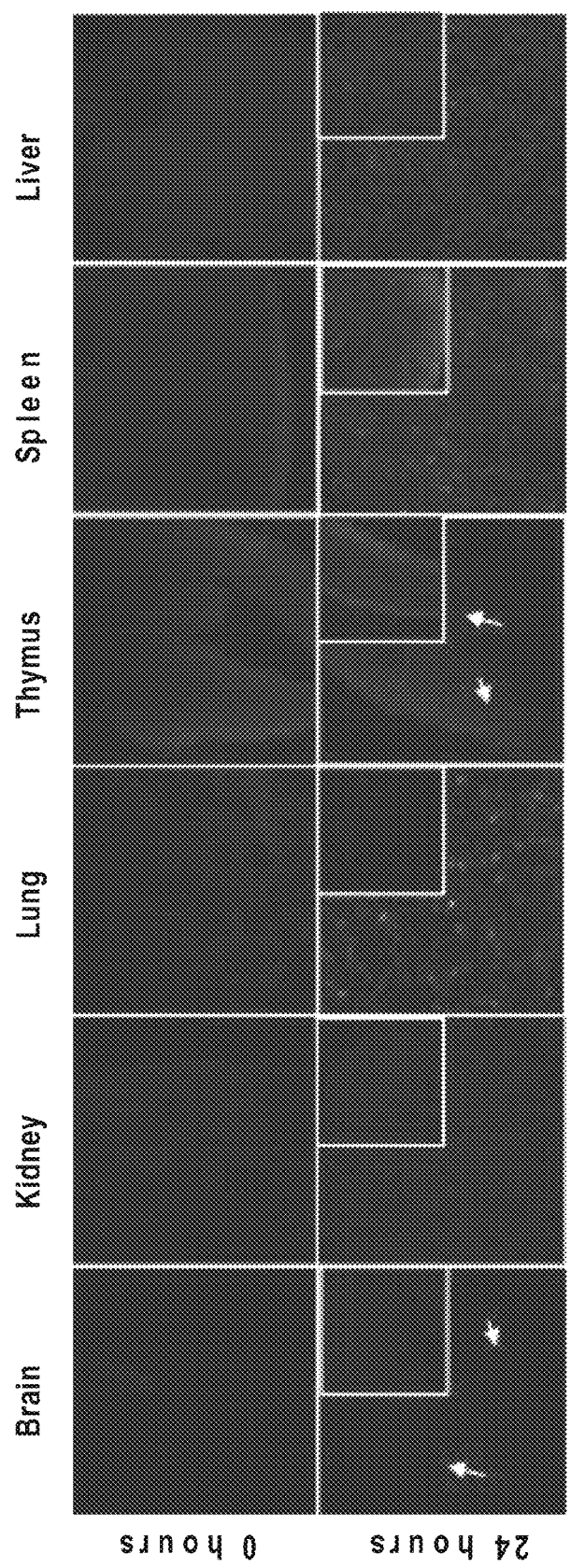
FIG. 2 shows (A-G) the redirection of IM to the spleen when treated with PS-IMP. Twenty-four hours after i.v. injection, FITC-PS-IMP localize to the lung, spleen and liver with few observed in the brain, kidney or thymus (a). In the spleen, FITC-PS-IMP were associated with similar numbers of Ly6C$^{hi}$ ΦIM, B220$^+$ B cells, CD3$^+$ T cells and NK1.1$^+$ NK cells in mock-infected animals (b,c). In WNV-infected animals, FITC-PS-IMP localized primarily to Ly6C$^{hi}$ ΦIM (b,c). Spleens were processed for flow cytometry on D7 p.i. and live cells (R1; d) were gated. From this population, CD45$^+$ leukocytes were selected (R2; d) and CD11b$^+$, Ly6G$^-$ monocytes were gated to exclude a small population of Ly6G$^+$ neutrophils (R3; d). FITC-PS-IMP were found in association with Ly6C$^{hi}$ ΦIM in WNV-infected animals, in contrast to Ly6C$^{lo}$ monocytes in mock-infected animals (e). Infusion of PS-IMP, and to a lesser extent, NP, resulted in accumulation of Ly6C$^{hi}$ ΦIM in the spleens on D7 p.i of WNV-infected animals (f) and a significant reduction in numbers of these cells in the blood (g). Immunohistochemistry data represent three separate experiments with 3 mice/group. Slides were counterstained with DAPI (blue) to identify cell nuclei. Flow cytometry data are means±SD and represent three separate experiments with 4-5 mice/group. Statistical analysis was conducted using one-way ANOVA and Tukey-Kramer post-test. P≤0.05 (*), P≤0.01 (), P≤0.001 (*), in comparing PS-IMP and NP to vehicle control groups. P≤0.05 (#), P≤0.01 (##), P≤0.001 (###), in comparing PS-IMP to NP groups.
Figure 2B:
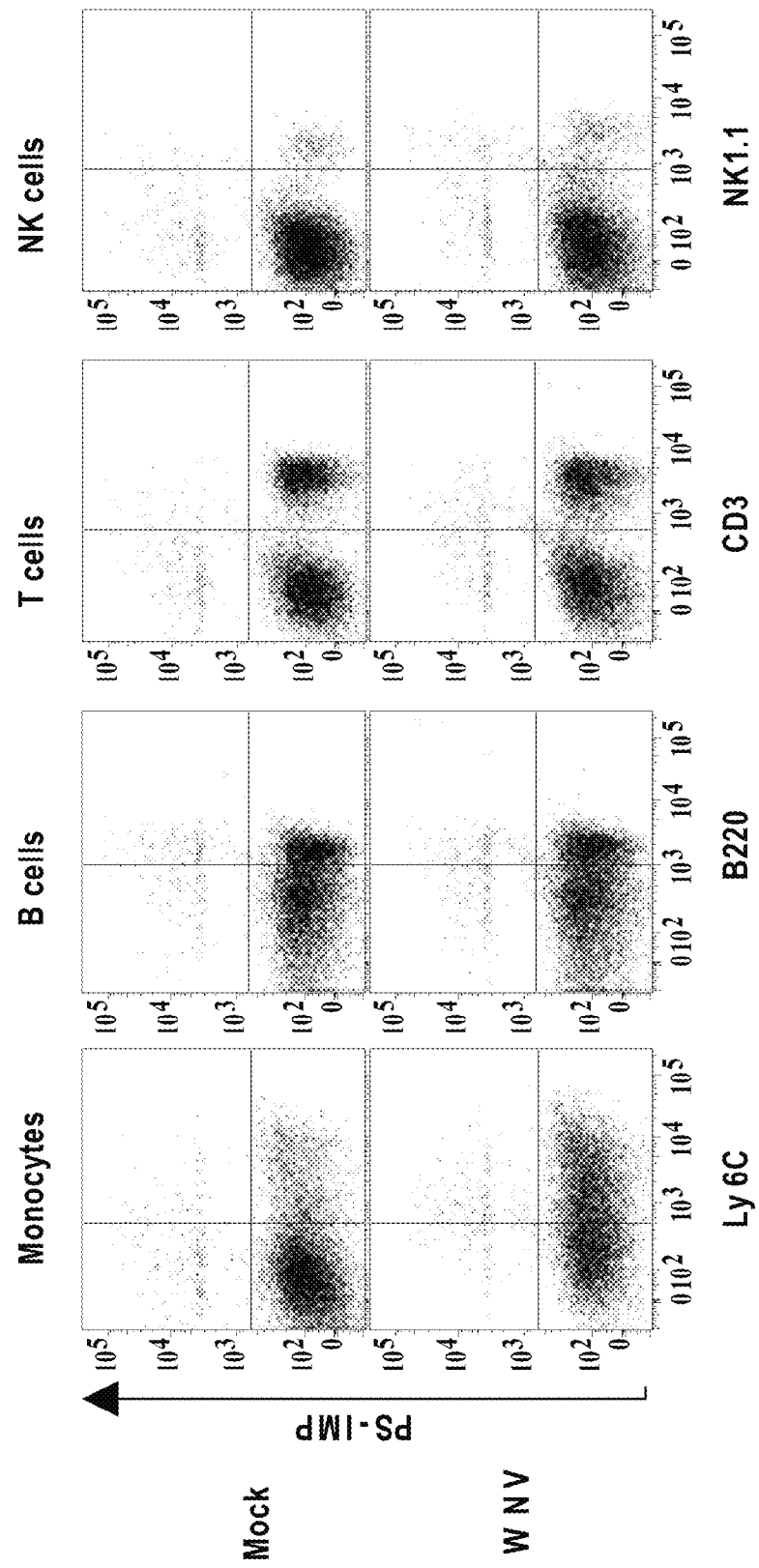
Figure 2C:
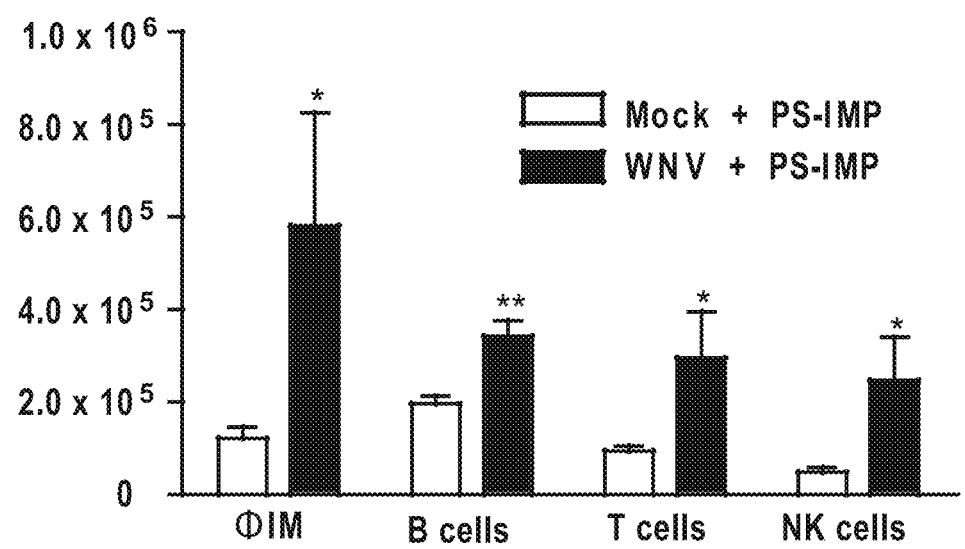
Figure 2D:
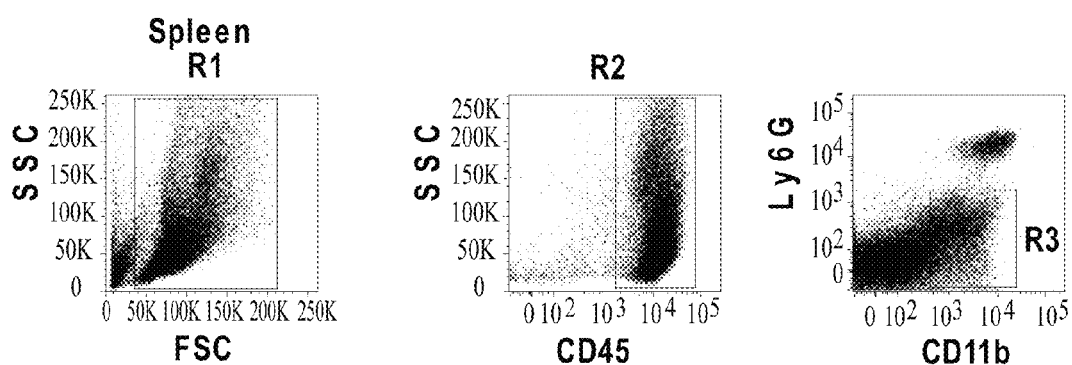
Figure 2E:
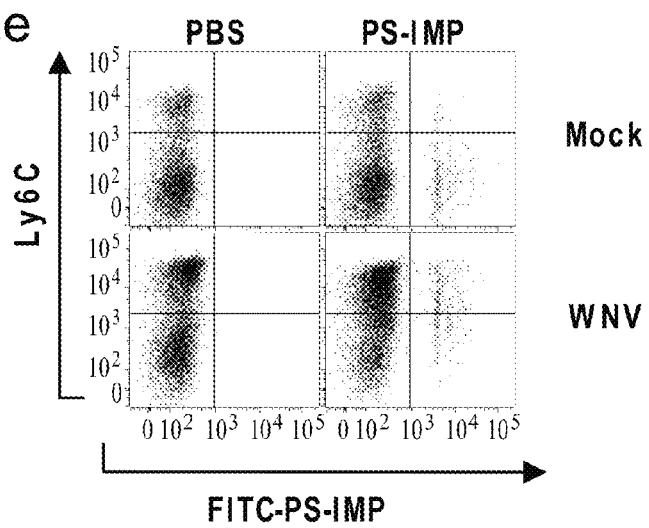
Figure 2F:
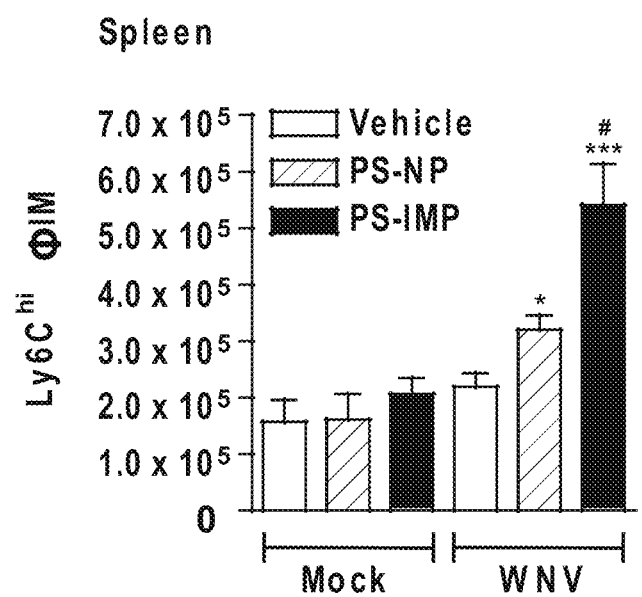
Figure 2G:
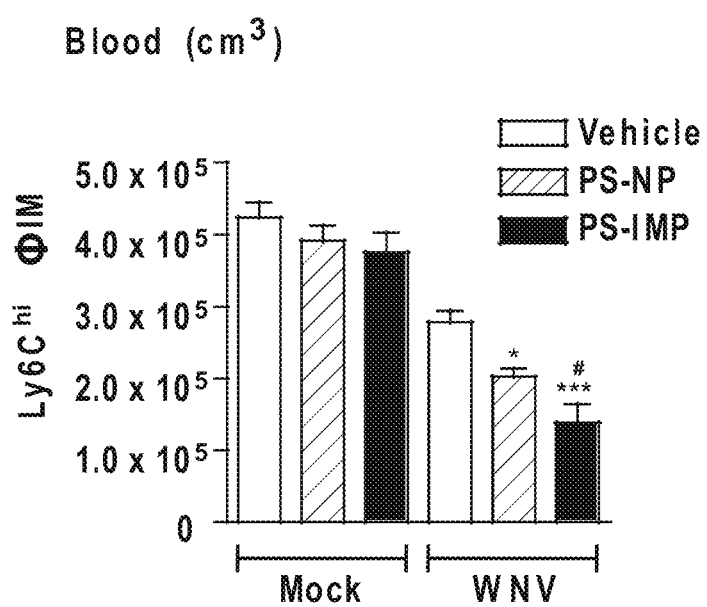

PS-IMP Treatment Results in Redirection of Inflammatory Macrophages to the Spleen Following infusion, PS-IMP predominantly localized to the lungs, spleen and liver (FIG. 2A), with no FITC$^+$ particles in the brain and thymus (FIGS. 7A-B) and none found in peripheral lymph nodes (data not shown). Flow cytometry revealed a relatively even distribution of IMP among inflammatory monocytes, BB20$^+$ B cells, CD3$^+$ T cells, and NK1.1 cells (FIG. 2 B-C), however, in infected mice, inflammatory monocytes were found to take up significantly more IMP than any other cell type in the spleen (FIG. 2 B-C). Within the circulation, the phenotype of IMP-containing monocytes in mock-infected mice was Ly6C-negative, whereas IMPs localized primarily to Ly6C-positive monocytes in the infected animal (FIGS. 2D-E). Furthermore, spleens from WNV-infected mice treated with FITC-PS-IMP had significantly more inflammatory monocytes than those treated with NP or vehicle control (FIG. 2F; FIG. 9), closely corresponding to a decrease in circulating inflammatory monocytes in the peripheral blood in these mice (FIG. 2G).

Figure 3A:
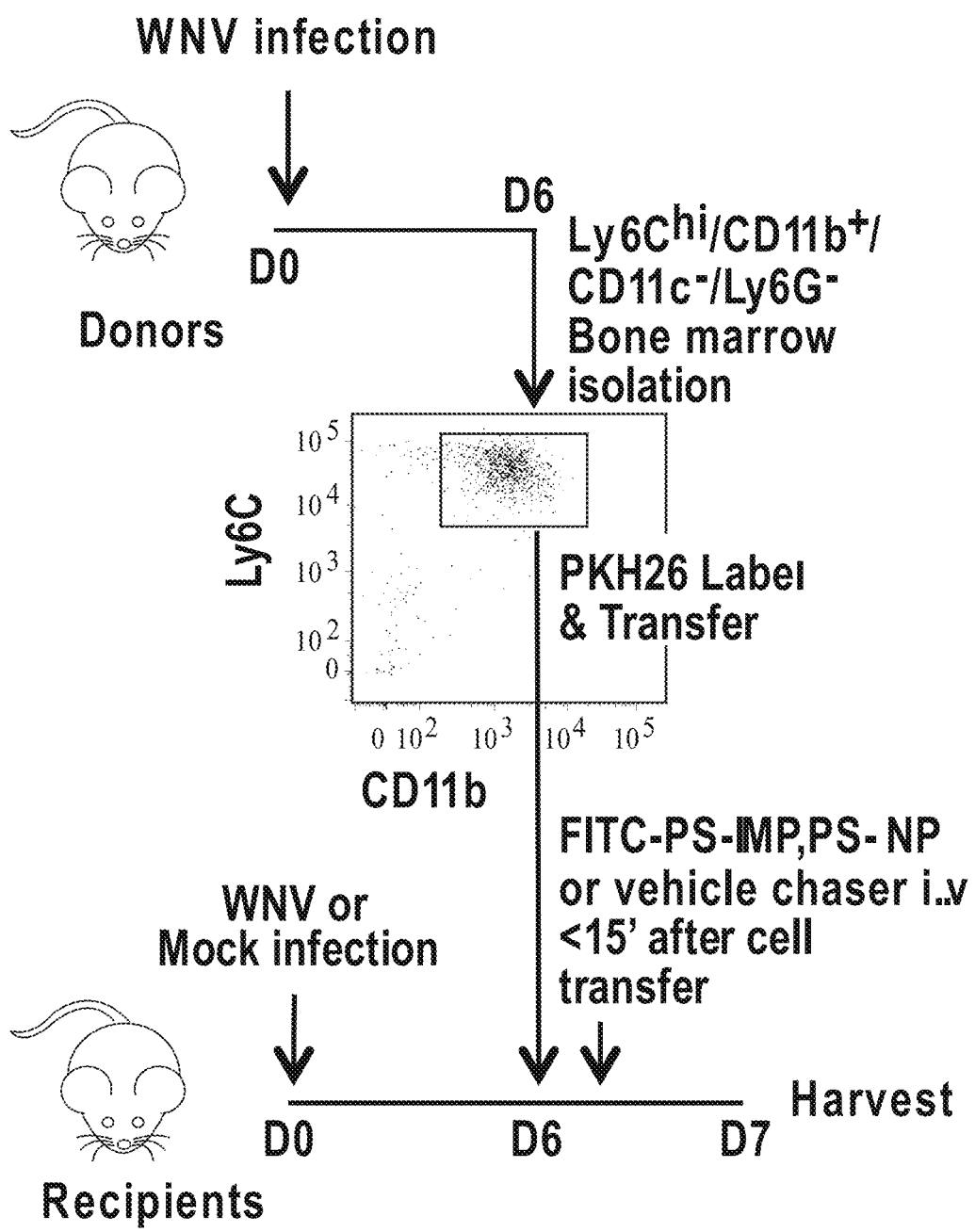
FIG. 3 shows (A-F) PS-IMP treatment reduces the homing of inflammatory monocytes to the CNS of WNV-infected mice. Ly6C$^{hi}$/CD11b$^+$/CD11c$^-$/Ly6G$^-$ΦIM were isolated from the bone marrow of mock-infected and WNV-infected donors on D6 p.i., labelled with PKH26 and injected into matched recipients on D6 p.i., immediately followed by a separate injection of vehicle, NP or PS-IMP (a). Brains (b) and spleens (c) were processed on D7 p.i. for flow cytometry and CD45$^{hi}$/CD11b$^+$ macrophages were gated (R1). PS-IMP significantly reduced the infiltration of adoptively transferred PKH26$^+$/Ly6C$^{hi}$ bone marrow-derived ΦIM into the brain (b, d) correlating with an accumulation of PKH26$^+$ cells in the spleen (c, e). Over 70% of adoptively transferred ΦIM found to have taken up FITC-PS-IMP in the spleen (i.e., PKH26$^+$/FITC$^+$ cells), differentiated into cells expressing CD11c and CD103. PS-IMP infusion into splenectomised mice (0, at the time of 5% weight-loss failed to reduce monocyte trafficking into the brain, with PS-IMP- and vehicle-treated animals having similar numbers of monocytes, as determined by flow cytometry (O. Flow cytometry data are means±SD and represent three separate experiments with 4-5 mice/group. Statistical analysis was conducted using one-way ANOVA and Tukey-Kramer post-test. P≤0.05 (*), P≤0.01 (), P≤0.001 (*), in comparing PS-IMP and NP to vehicle control groups. P≤0.05 (#), P≤0.01 (##), P≤0.001 (###), in comparing PS-IMP and NP groups.
Figure 3B:
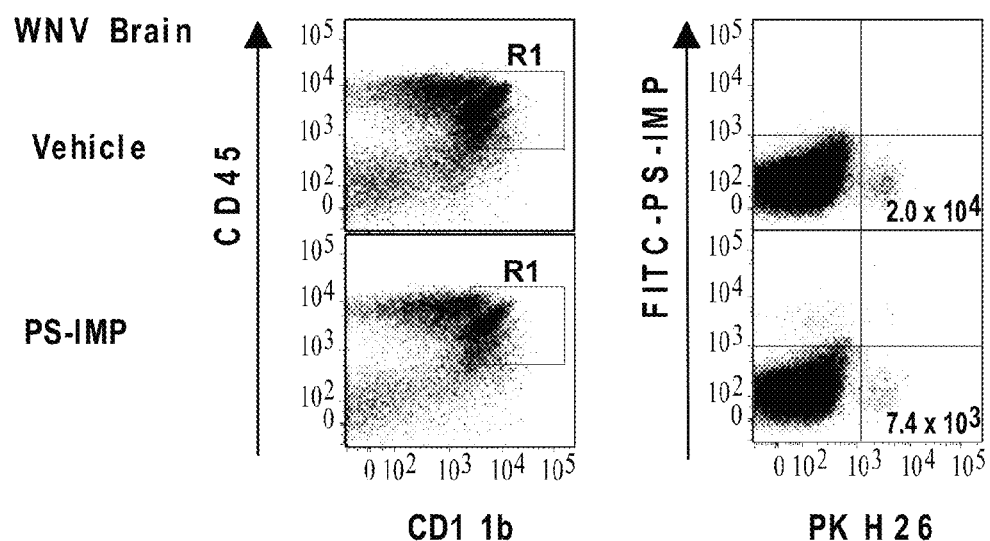
Figure 3C:
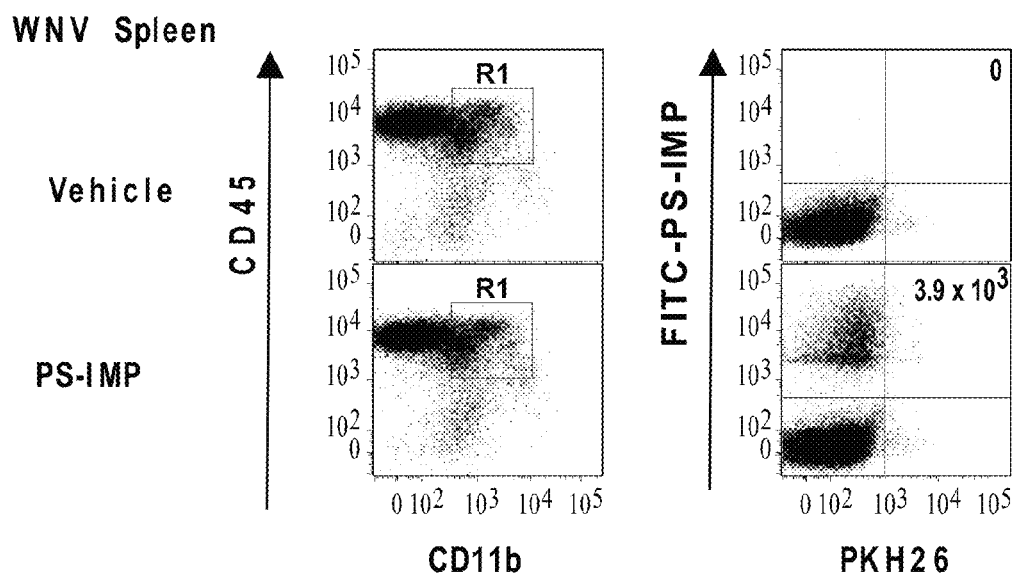
Figure 3D:
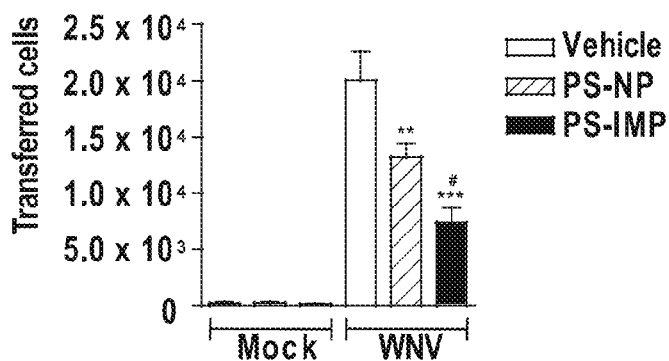
Figure 3E:
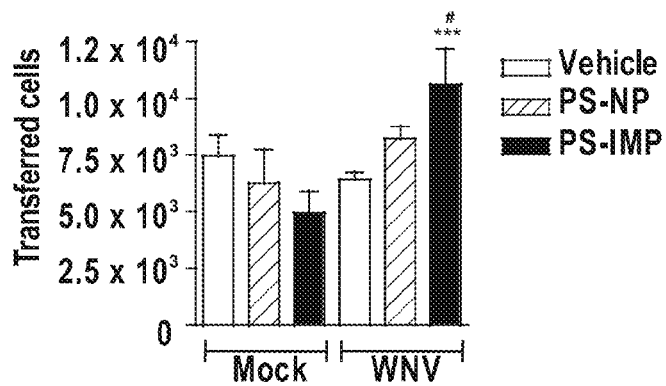
Figure 3F:
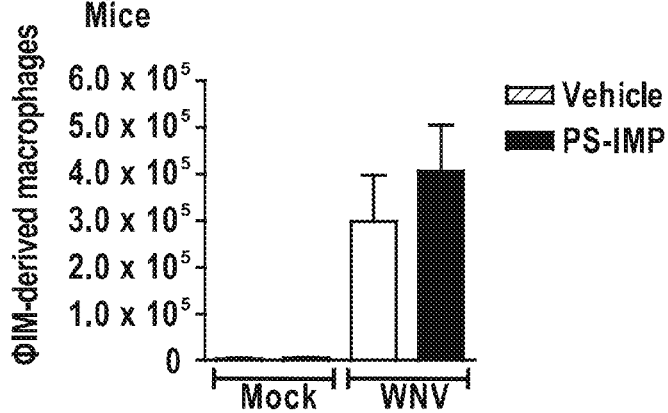

It has previously been shown that morbidity in WNV encephalitis is caused by inflammatory monocytes (Terry et al., 2012; Getts et al., 2012). When combining these previous findings with the data obtained here, we hypothesized that IMPs mediate their therapeutic activity by binding to inflammatory monocytes, abrogating their migration to the inflamed brain instead diverting them to the spleen. To confirm this, Ly6C$^{hi}$ monocytes were sorted from the bone marrow of WNV-infected mice on D6 p.i., labelled with PKH26 and transferred i.v. into mock- or WNV-infected recipients on D6 p.i (FIG. 3A). This was followed immediately by injection with PS-IMP, NP or vehicle only. PKH26-labelled Ly6C$^{hi}$ inflammatory monocytes trafficked into the WNV infected brain, differentiating into macrophages, with no peripheral immune cells observed in the mock-infected brain (FIG. 3B, data not shown). As described in Getts et al. (J. Exp. Med. 205:2319-2337, 2008) PS-IMP treatment reduced the host inflammatory monocyte infiltration into the WNV-infected brain (FIG. 3B), with significantly fewer adoptively-transferred PKH26$^+$ cells migrating into the brain (FIGS. 3B and 3D). Migration of PKH26-labelled cells into the spleen (FIGS. 3C and 3E) was observed in mock- and WNV-infected mice, however, PS-IMP treatment resulted in significantly more Ly6C$^{hi}$ monocyte accumulation in the spleens of WNV-infected mice (FIG. 3E). The importance of the spleen in the efficacy of IMP treatment was confirmed in splenectomised mice. IMP infusion failed to reduce immigration of inflammatory monocytes into the brains of WNV-infected splenectomised mice, compared to splenectomised, vehicle-treated, WNV-infected control mice (FIG. 3F). The spleen has recently been shown to harbour a reservoir of monocytes, identified as CD11b$^+$/Ly6C$^{hi}$/CD11c$^-$, that may be recruited from the spleen under certain inflammatory conditions (Swirski et al., Science 325:612-616; 2009; Leuschner et al., J. Exp. Med. 209:123-137, 2012; Robbins et al., Circulation 125:364-374, 2012). We hypothesized that IMP infusion enhanced this pool of splenic monocytes. However, more than 70% of the adoptively transferred monocytes that had taken up IMP and migrated to the spleen, expressed CD11c and CD103 (FIGS. 3E and 3G), making this hypothesis unlikely. Taken together these data suggest that infused IMP are taken up by inflammatory monocytes, which are diverted to the spleen, resulting in reduced inflammatory monocyte numbers in the blood for migration into sites of inflammation.

Example 5

IMPs Inhibit Inflammatory Monocyte Migration into the Inflamed Peritoneum

Figure 4A:
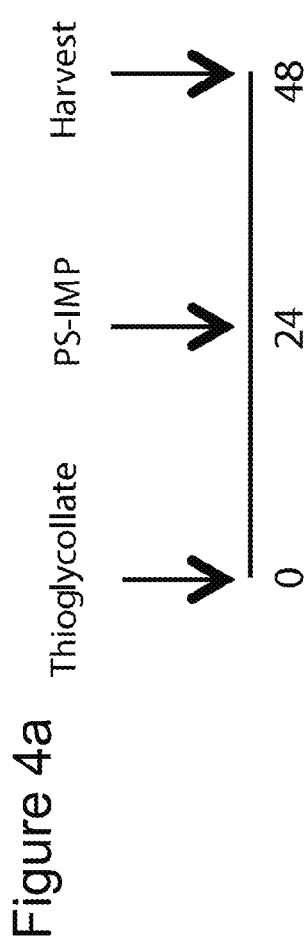
FIG. 4 shows (A-I) inflammatory monocytes express MARCO, which is crucial for IMP activity. PS-IMP were tested for their ability to inhibit monocyte migration into the thioglycollate-inflamed peritoneum (regimen shown in a).
Figure 4B:
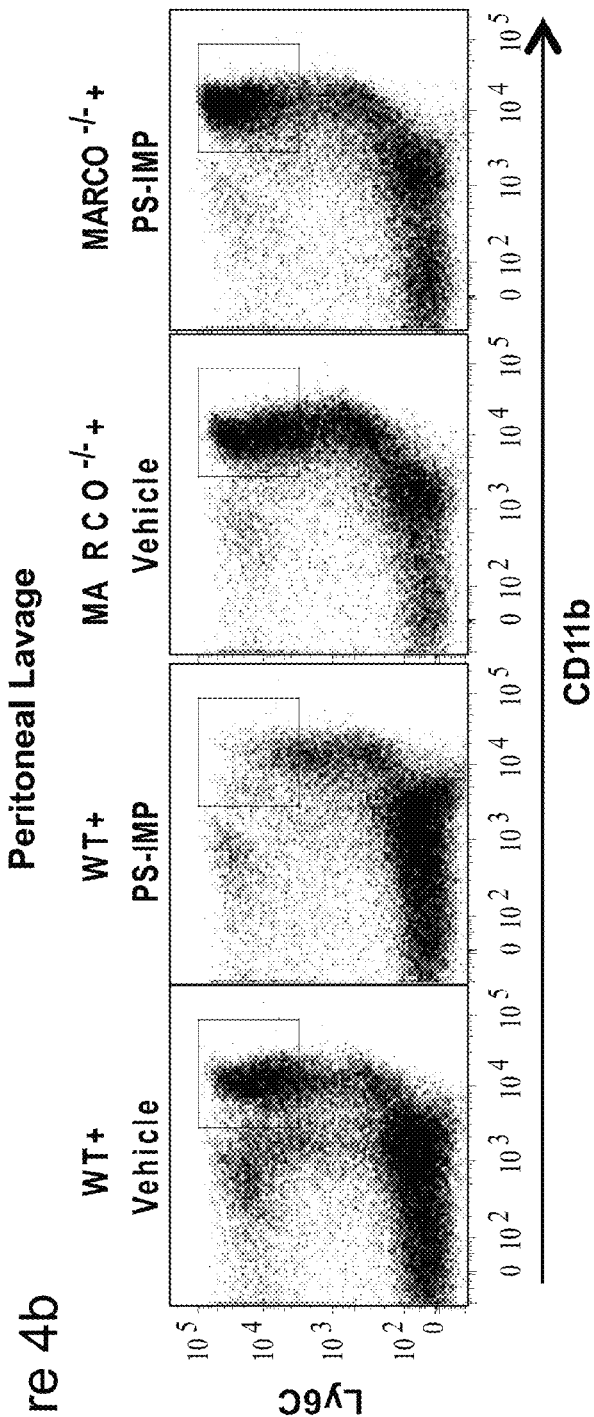

It is clear that monocytes are an important mediator of immune pathology observed during WNV encephalitis, however, infection results in a complex array of immune responses involving other cellular subsets. To address the specificity of IMP to inflammatory monocytes during inflammation, a model of sterile macrophage-mediated peritoneal inflammation was used. The migration of leukocytes into the thioglycollate-inflamed peritoneum follows a stereotypical pattern, with neutrophils elicited within the first 4-18 hours, followed by the CCR2-dependent accumulation of ΦIM-derived macrophages from approximately 12 hours onwards (Tsou, et al., 2007). Infusion of either PS-IMP (FIG. 7D-E; FIG. 4A-B) or PLGA-IMP (not shown), 24 hours after intraperitoneal thioglycollate injection, significantly reduced inflammatory monocyte trafficking into the site of inflammation which was abrogated in splenectomised mice (FIG. 7F). This data together both highlight the anti-inflammatory nature of IMP in a predominately macrophage mediated inflammatory model but also the importance of the spleen for IMP efficacy.

Example 6

Inflammatory Monocytes Express MARCO, which is Crucial for IMP Activity

Figure 4C:
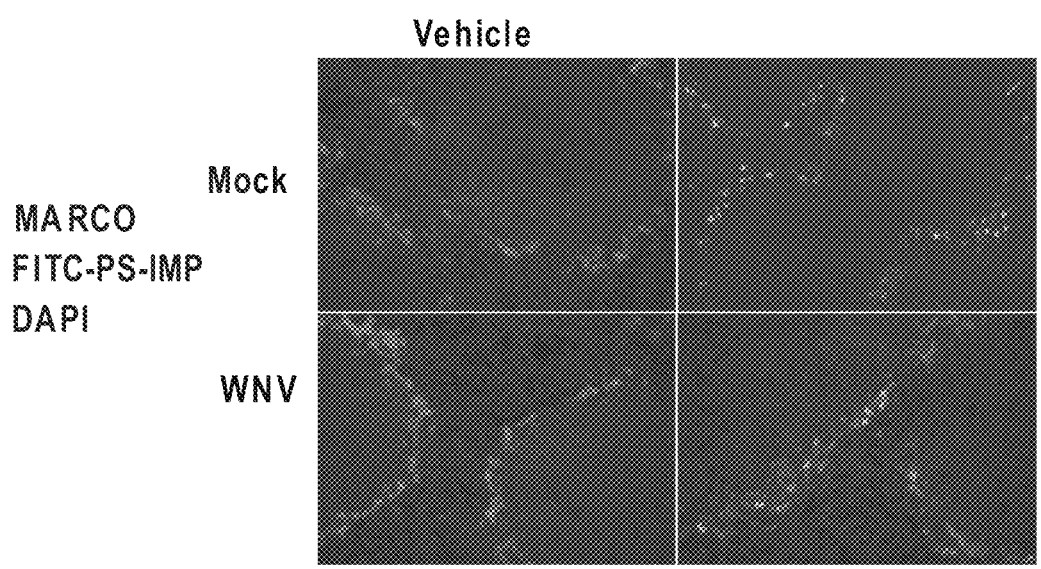
Figure 4D:
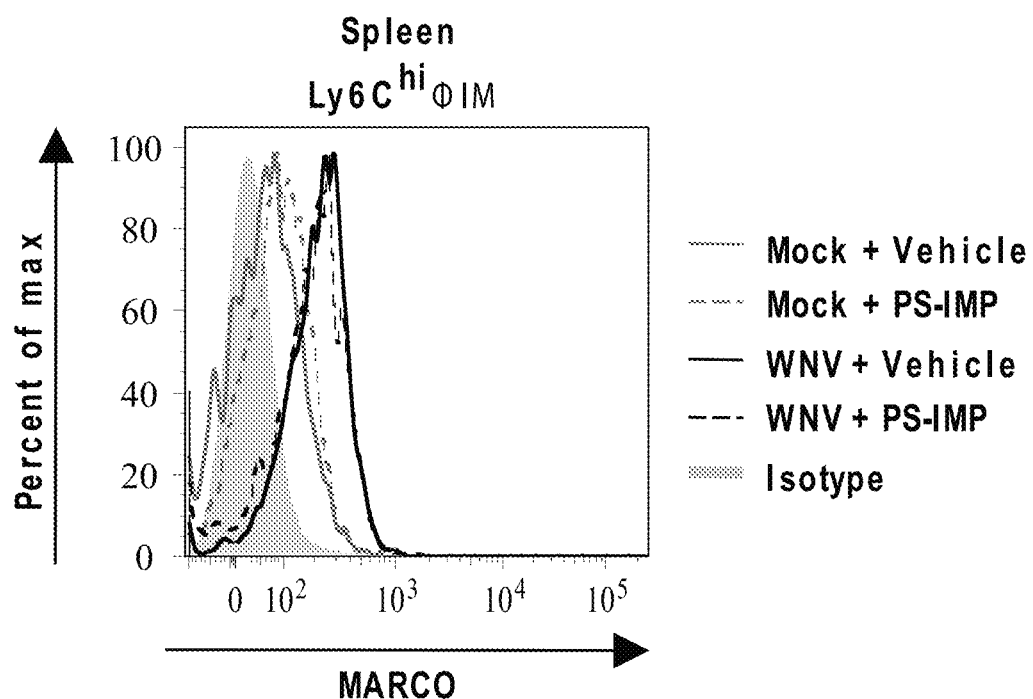
Figure 4E:
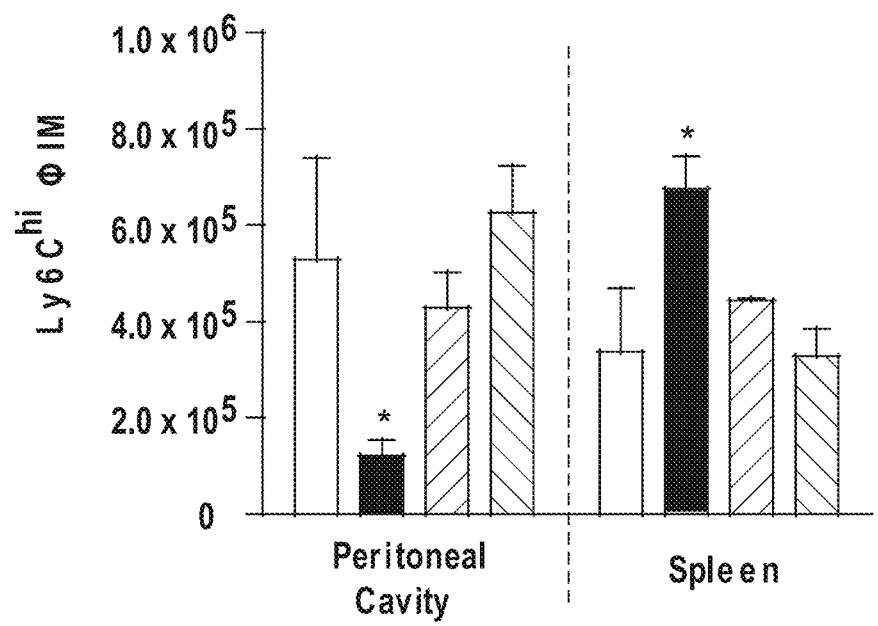
Figure 4F:
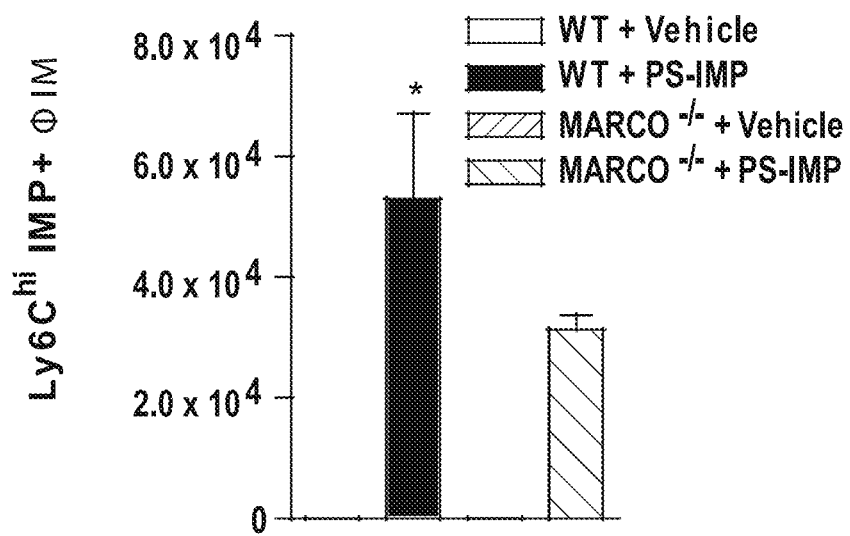
Figure 4G:
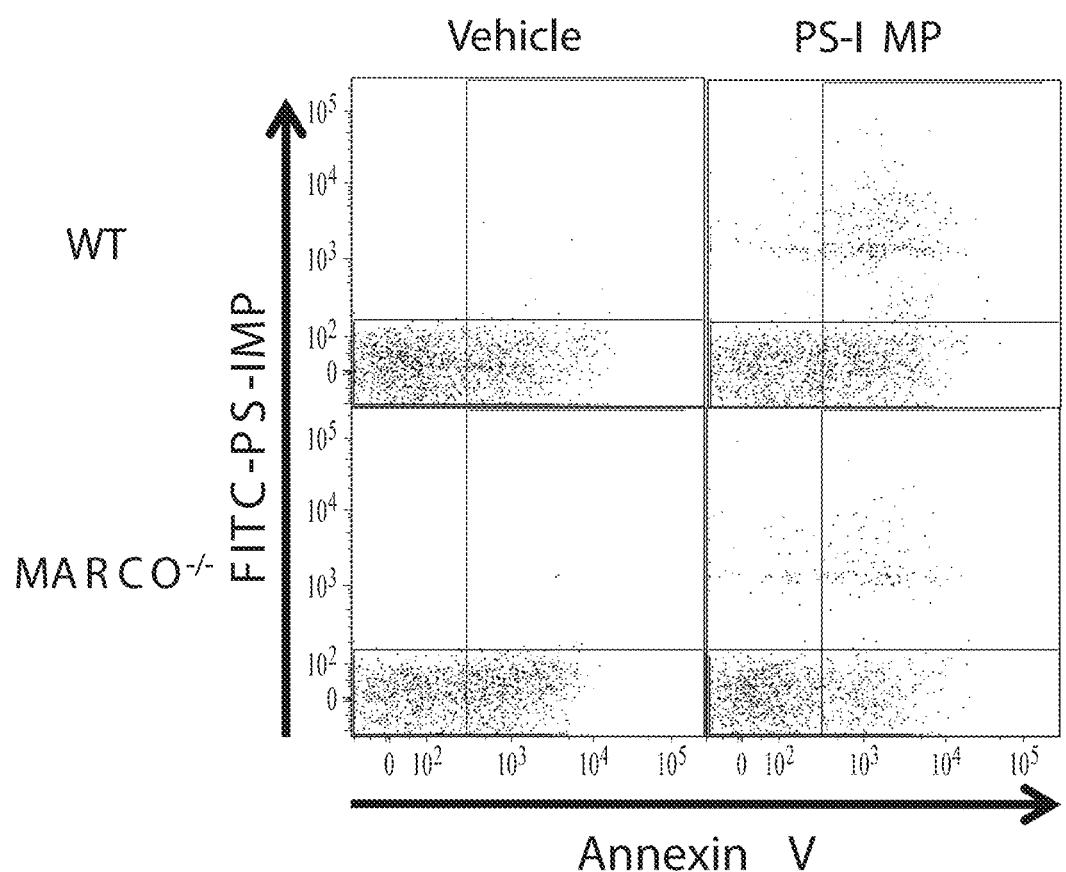
Figure 4H:
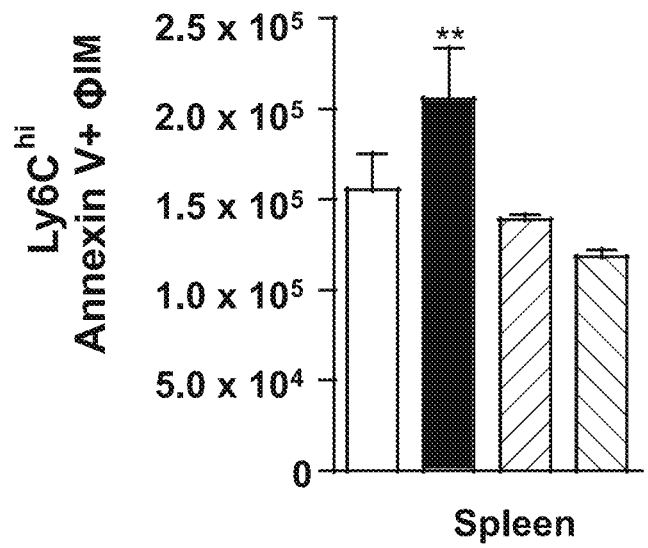
Figure 4I:
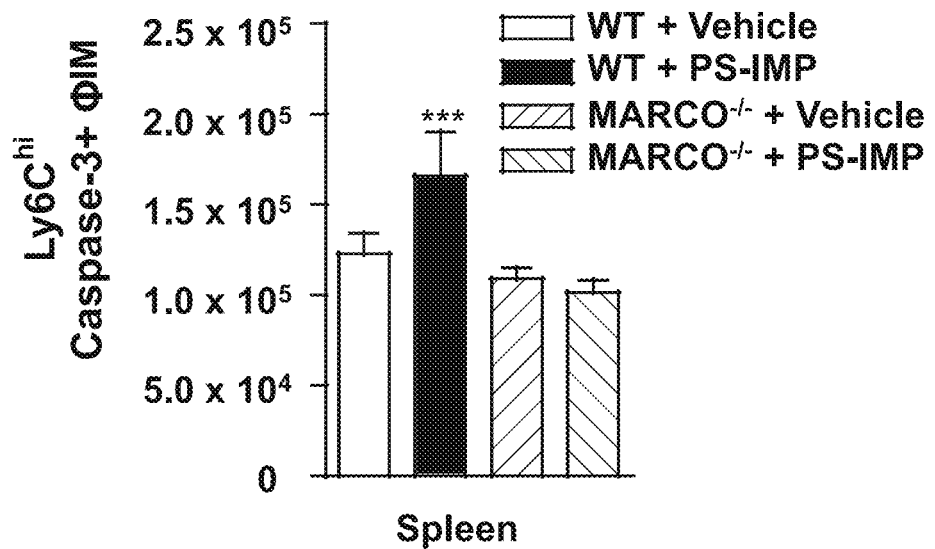

Particles such as IMP are to be taken up through scavenger receptor pathways (Kanno et al., 2007). One key scavenger receptor specifically implicated in the binding of negatively-charged particles as well as polystyrene is MARCO (Chao, et al., 2012; Kanno, et al., 2007). In the spleen, PS-IMP co-localized with MARCO expressing cell populations in the marginal zone, similar to what we have previously described for apoptotic cell uptake after intravenous infusion (Getts, et al., 2011; Getts, et al., 2012) (FIG. 4C). MARCO was also found to be up-regulated on Ly6c$^{hi}$/CD11b$^+$/CD11c$^-$ ΦIM isolated from the spleen of WNV-infected but not mock-infected animals (FIG. 4D). To further address the role of MARCO, peritoneal inflammation was induced in MARCO-deficient (MARCO$^{-/-}$) animals using thioglycollate. Similar numbers of peritoneal monocytes were isolated from WT and MARCO$^{-/-}$ mice 48 hours after thioglycollate administration (FIG. 4B, 4E). However, unlike WT mice, where PS-IMP treatment resulted in reduced numbers of Ly6C$^{hi}$/CD11b$^+$ ΦIM in the peritoneum, PS-IMP treatment infusion did not reduce the number of peritoneal Ly6C$^{hi}$/CD11b macrophages isolated from MARCO$^{-/-}$ animals (FIG. 4B, 4D), directly pointing for a role for MARCO in the uptake and efficacy of IMP. In addition, MARCO has been shown to also play a direct role in the apoptosis induction in macrophages that have engulfed silica particles (Hamilton et al., 2006). Interestingly, IMP significantly increased the numbers of annexin V and caspase-3 positive inflammatory monocytes in the spleens of WT mice but not MARCO$^{-/-}$ mice 2 hours after infusion of PS-IMP (FIG. 4G-I; FIG. 11B) or PLGA-IMP (not shown). Apoptosis is induced in both neutrophils and inflammatory monocytes and is detectable within 2 hours after IMP infusion (FIG. 10). Mice were injected with PS-IMP or PBS and sacrificed 2 hours later. Spleens were removed, processed into single cell suspensions and stained with anti-CD11b, Ly6C, CD11b, Ly6G, Fixable viability dye eFluor780 (eBioscience). Apoptotic cells were detected using the CaspGLOW™ Fluorescein Active Caspase-3 Staining Kit. Infusion of PLGA-IMP into thioglycolate-induced WT mice resulted in a significant increase in numbers of $Ly6C^{hi}$ ΦIM and $Ly6G^+$ neutrophils which expressed the apoptosis markers annexin V and caspase-3. This was not observed in mock treated animals. Two hours after injection (FIG. 11), PS-IMPs were localized in CD11b+ Ly6C+Ly6G− monocytes in the spleens of mock and TG peritonitis-induced mice. Uptake of PS-IMP was associated with activity of the enzyme Caspase-3, indicative of apoptosis (a). An increased number of monocytes were positive for caspase-3 activity in PS-IMP treated, TG peritonitis-induced mice (b).

There were very few necrotic cells (less than 5%) which indicates that the cell death is not associated with degrading IMPs.

Taken together, the data suggest that IMP are likely to be taken up through the MARCO scavenger receptor, which may mediate downstream signaling 7 pathways that result in inflammatory monocyte migration, accumulation and subsequent apoptosis in the spleen.

Example 7

IMP Therapy Inhibits Inflammatory Monocytes in EAE

Figure 5A:
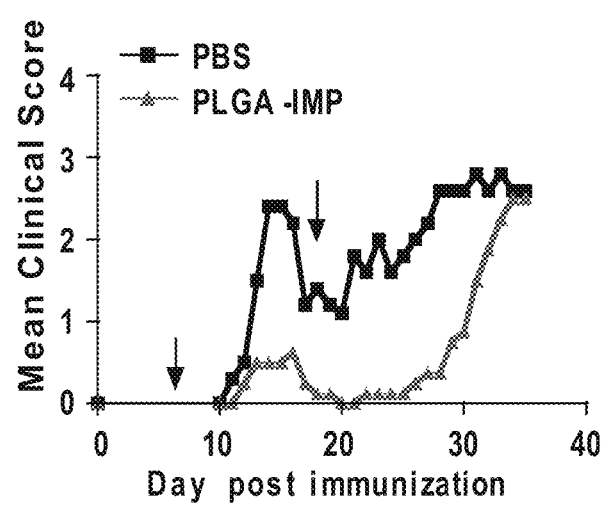
Figure 5B:
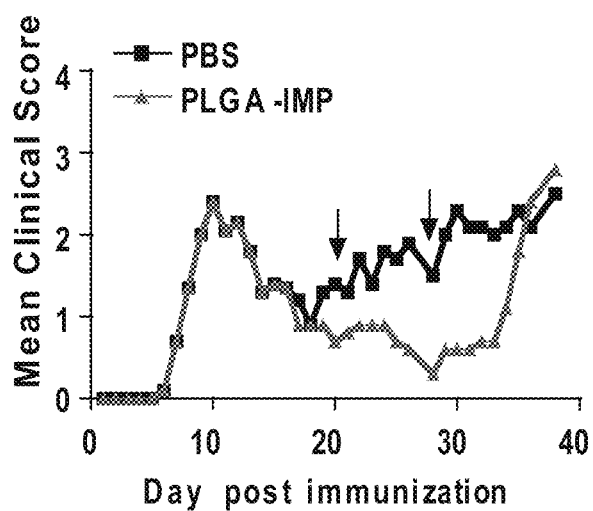
Figure 5C:
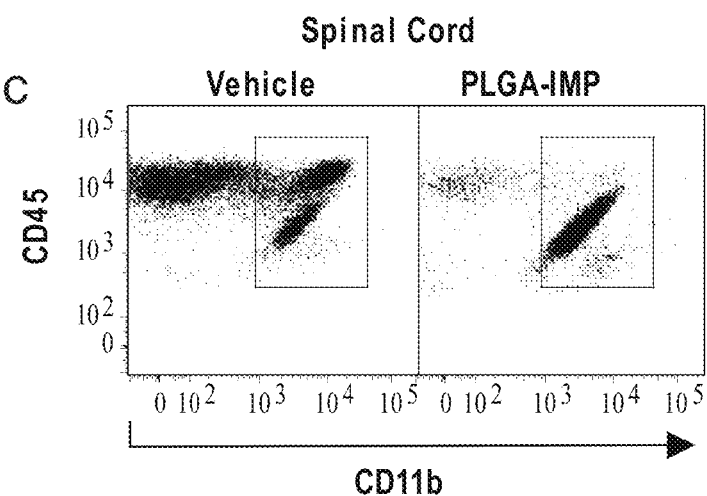
Figure 5D:
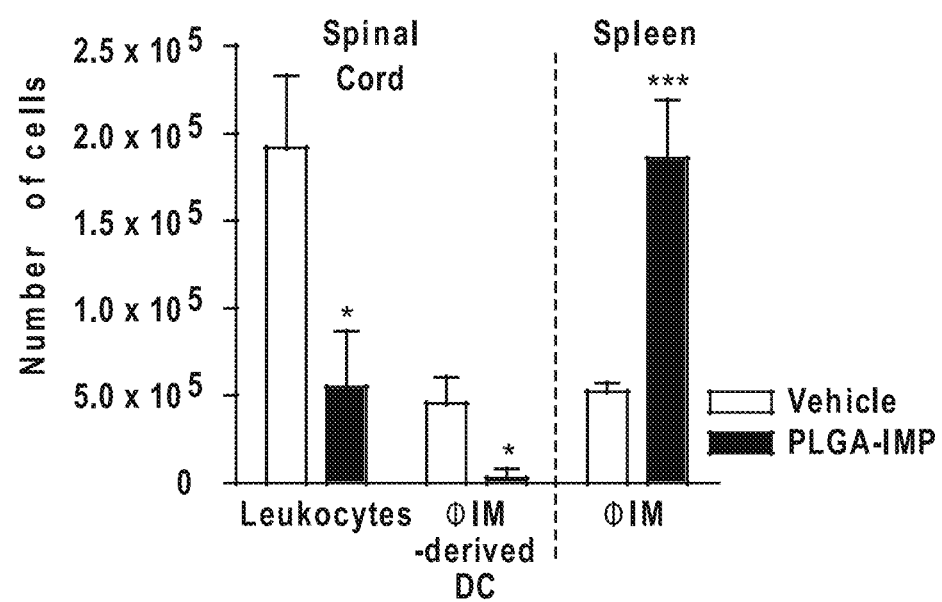
Figure 5H:
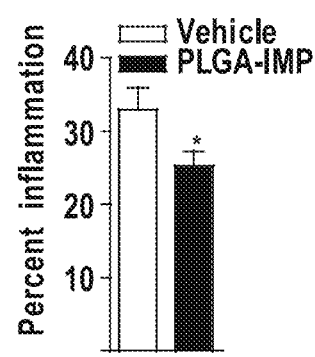
Figure 8A:
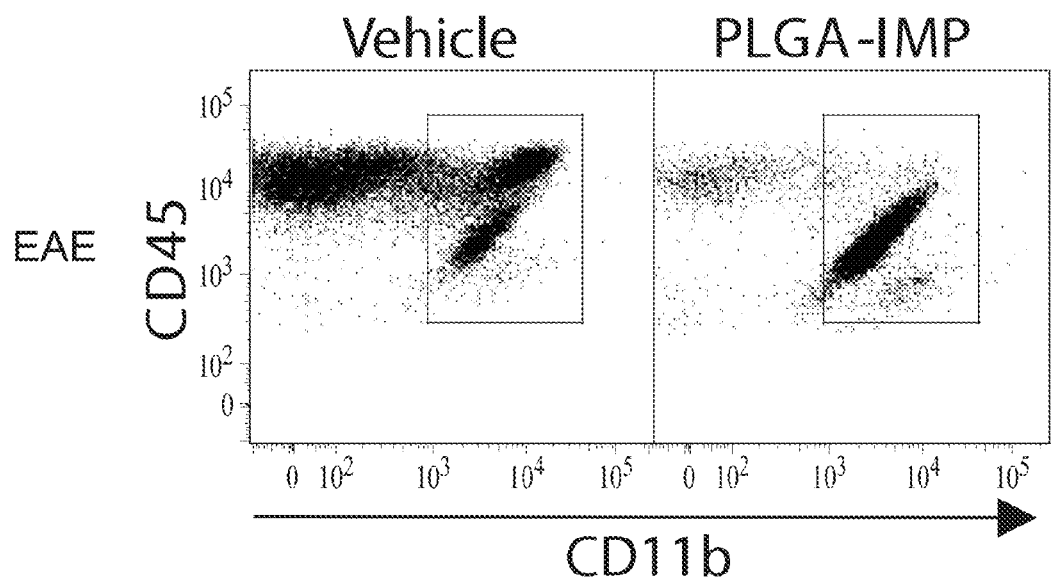
Figure 8B:
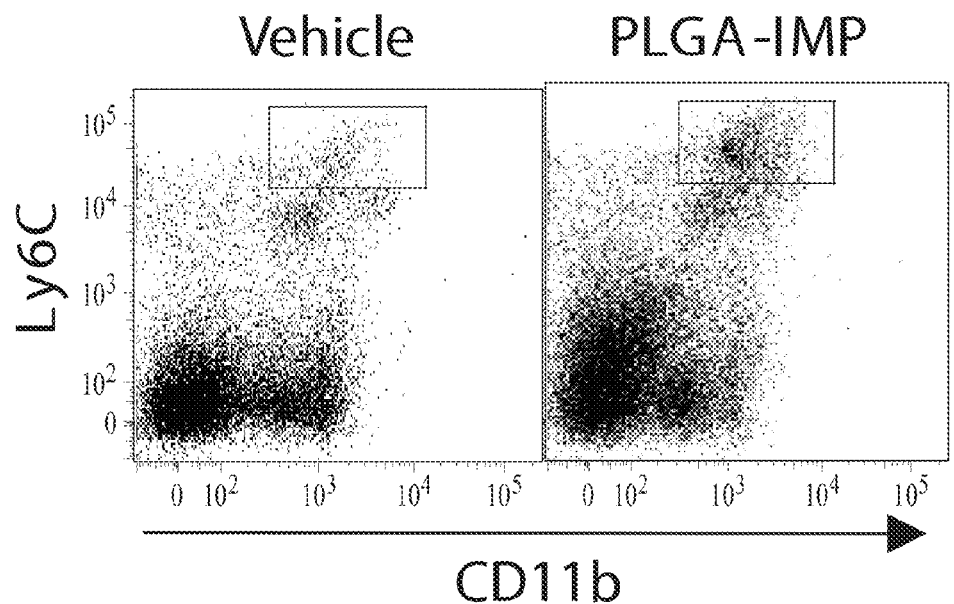

To further understand the therapeutic potential of IMP, a number of non-related inflammatory disease models were examined. Firstly, another non-infectious model of CNS inflammation was tested, namely experimental autoimmune encephalomyelitis (EAE). In EAE circulating $Ly6C^{hi}$ inflammatory monocytes differentiate into macrophages and microglia, in EAE these same cells differentiate predominately into $CD11c^+$ DC that promote T cell activation and epitope spreading (Getts et al., J. Exp. Med. 205:2319-2337, 2007; King et al., Blood 113:3190-3197, 2009; Getts et al., J. Neuroinflammation, In Press). Daily intravenous infusion of biodegradable PLGA-IMP over 7 days at the time of disease onset, both ameliorated disease during treatment and was associated, with a prolonged benefit, as determined by the lack of symptoms for 14 days after treatment cessation (FIG. 5A). More importantly, daily infusion of IMP treatment during primary disease resulted in a reduced disease score and inhibition of relapse initiation, during the treatment period (FIG. 5B). Reduced disease scores in animals treated at onset, correlated with reduced inflammation in the spinal cord, as determined by flow cytometry (FIGS. 5C,D and FIG. 8A), with the most striking reduction observed within the inflammatory monocyte-derived DC compartment (FIGS. 5C-D and FIG. 8A). Similar to observations in animals suffering WNV encephalitis or peritonitis, the reduction of inflammatory monocytes in the EAE CNS, correlated with a significant accumulation of Ly6C-expressing monocytes in the spleen (FIG. 5D and FIG. 8B).

Example 8

IMP Therapy Reduces Damage Caused by Ischemial Reperfusion

Figure 5I:
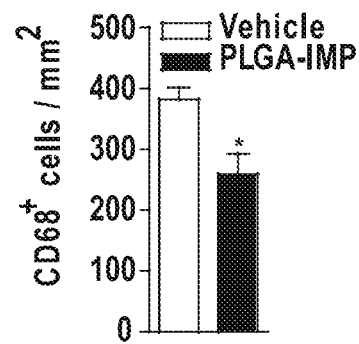
Figure 5J:
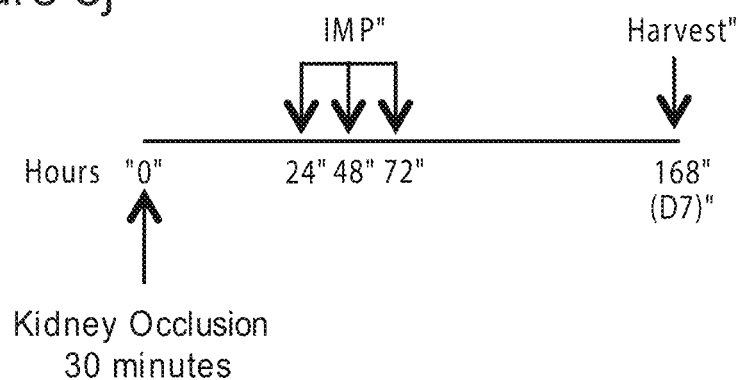
Figure 5K:
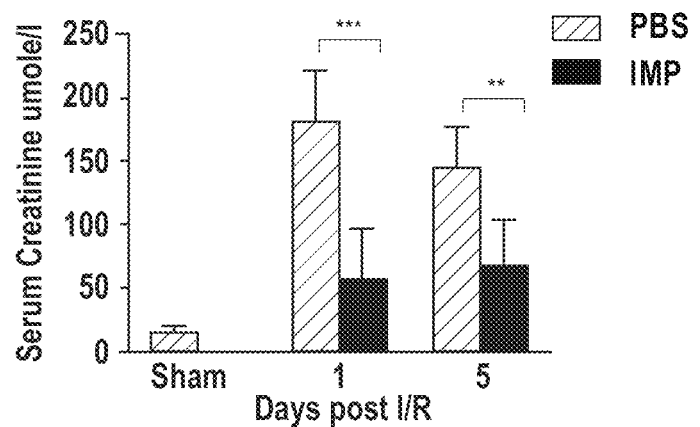
Figure 5L:
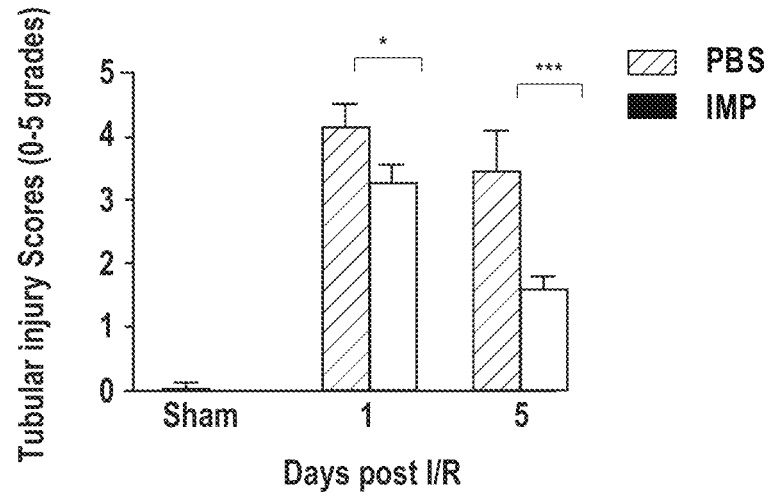
Figure 5M:
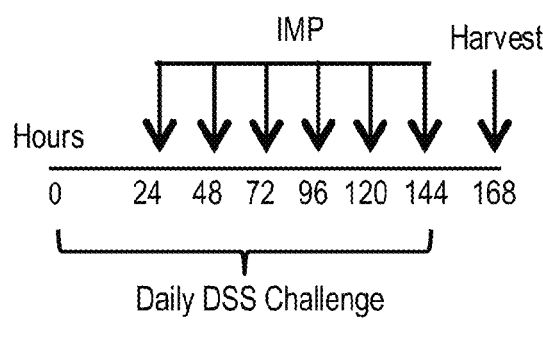
Figure 5N:
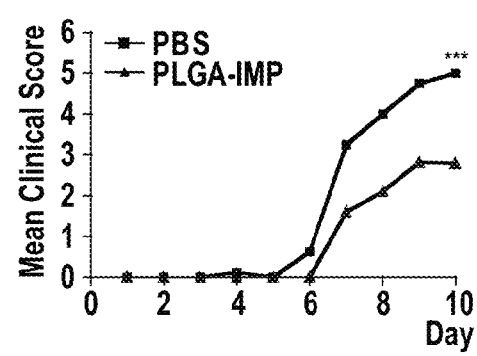
Figure 5O:
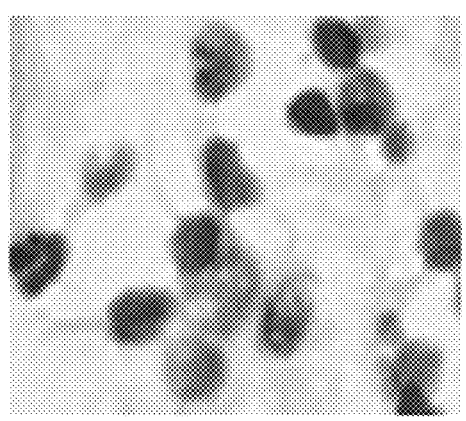
Figure 5P:
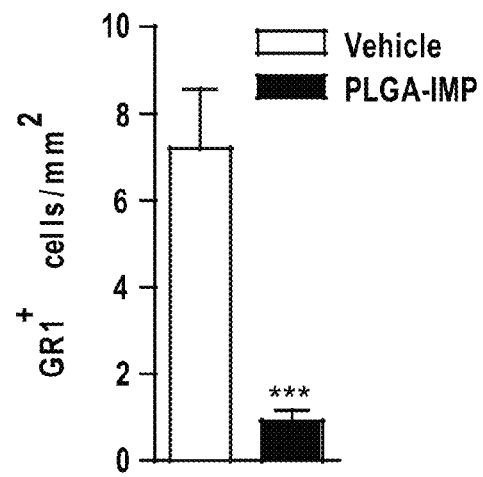
Figure 6A:
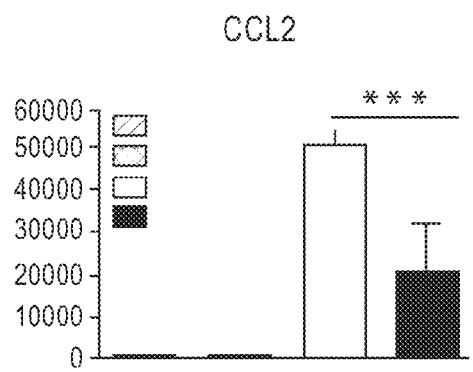
Figure 6B:
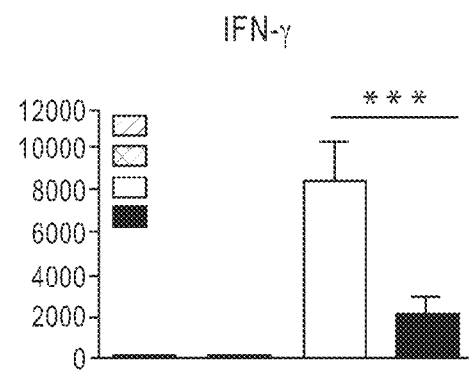
Figure 6C:
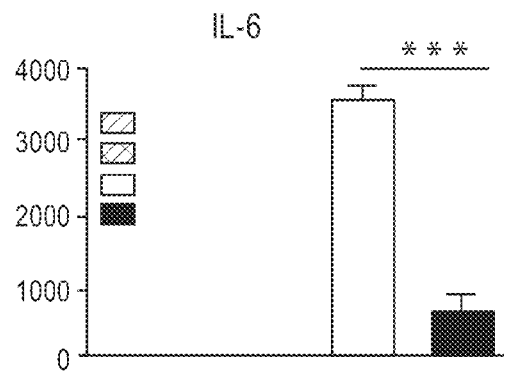
Figure 6D:
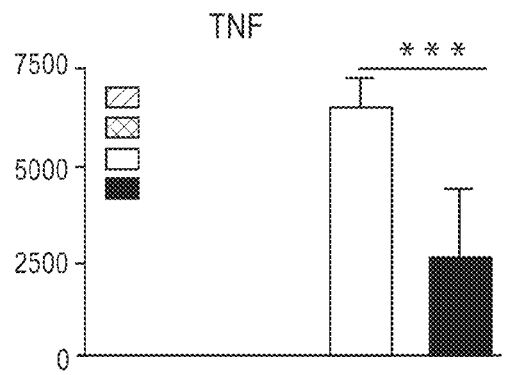
Figure 6I:
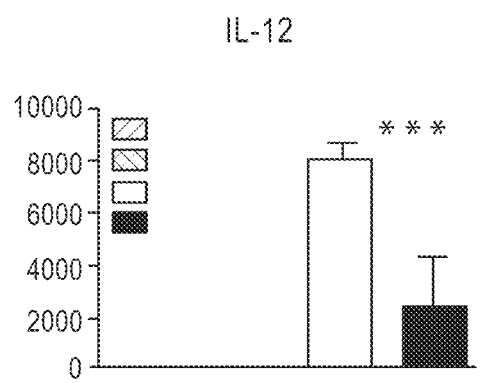
Figure 6J:
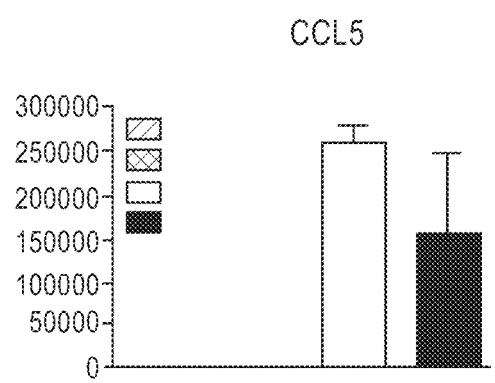
Figure 6K:
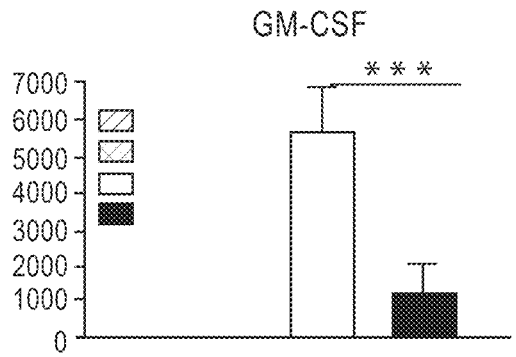
Figure 6L:
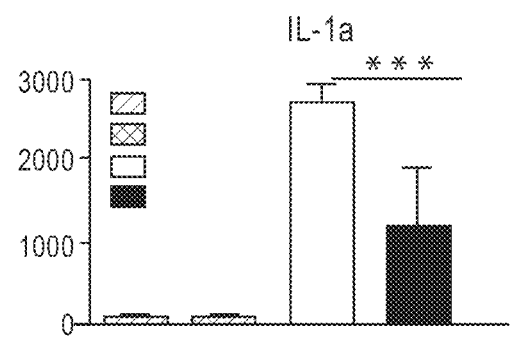
Figure 6M:
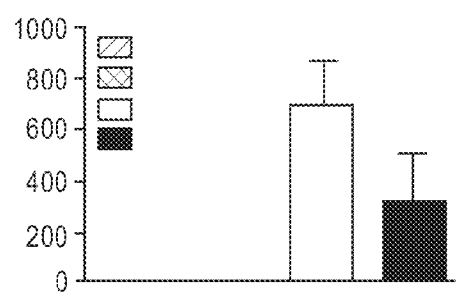
Figure 6N:
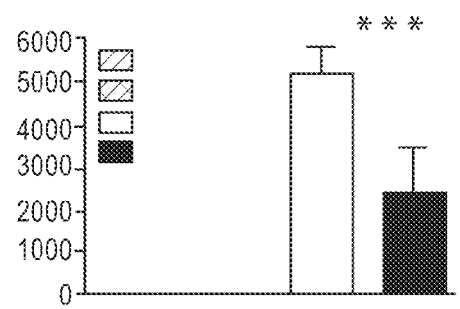
Figure 6O:
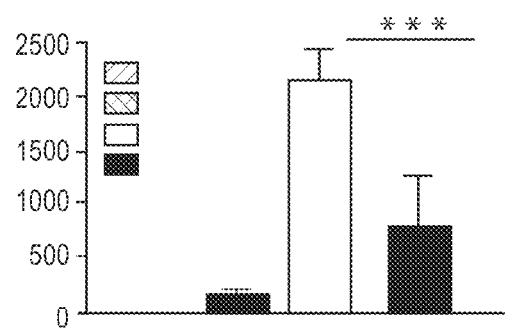
Figure 6P:
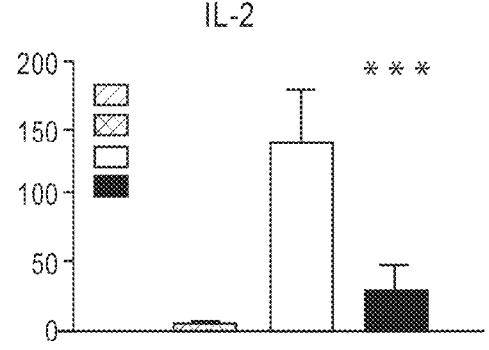
Figure 8D:
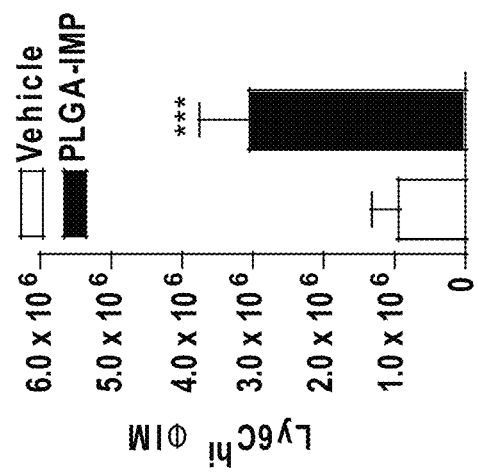
Figure 8C:
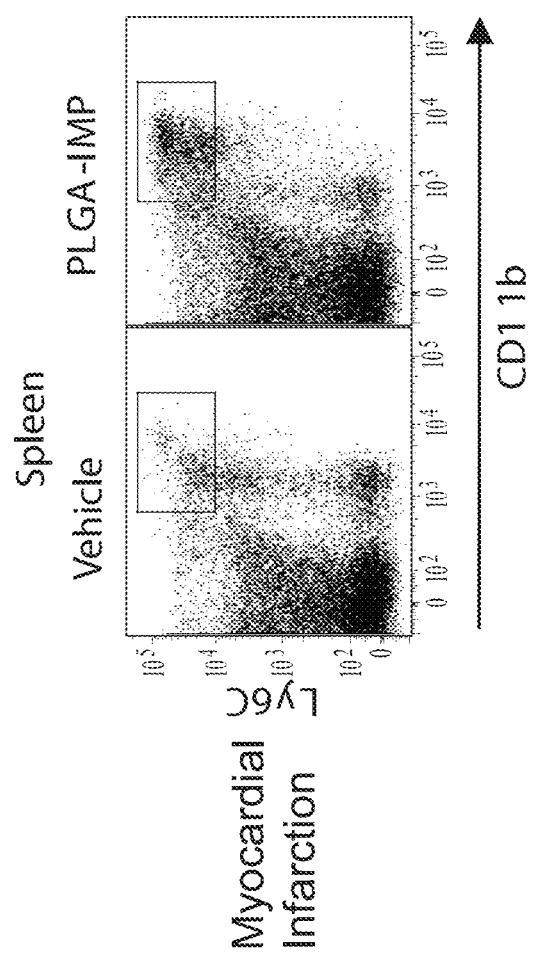
Figure 8F:
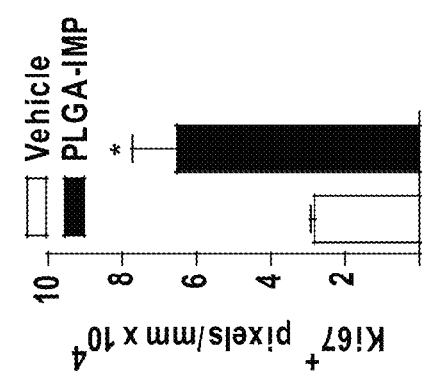
Figure 8E:
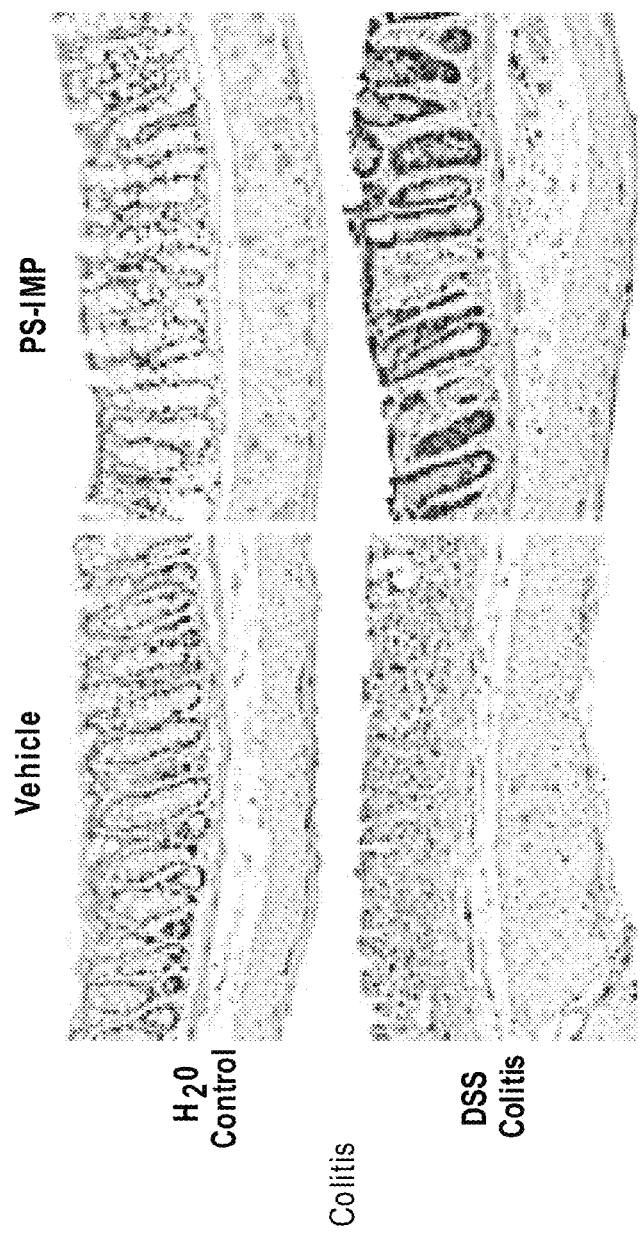

Inflammatory monocytes have been implicated in the pathogenesis of cardiac diseases including atherosclerosis and cardiac infarction, and correlate with poor outcomes (Swirski et al., Science 325:612-616,02009; Leuschner et al., J. Exp. Med. 209:123-137, 2012; Robbins et al., Circulation 125:364-374, 2012; Bailey et al., Nat. Immunol 8:172-180, 2007). Using the permanent left anterior descending artery occlusion model (Yeap et al., Methods in Molecular Biology, In Press), the impact of 3 days of PLGA-IMP treatment (FIG. 5H) was determined. In vehicle-treated animals, occlusion resulted in a strong monocytic infiltration into the myocardium, with up to 40% of the left ventricular wall involved (FIG. 5I-J). IMP treatment significantly reduced the size of the inflammatory focus, reducing overall cardiac inflammation by 15-20% (FIG. 5i,j). Furthermore, a significant reduction in $CD68^+$ macrophage numbers within the infarct area was observed, with IMP treatment resulting in a 30% reduction in the number of $CD68^+$ cells/mm$^2$, relative to the vehicle-treated control (FIGS. 5K,L). Importantly, this reduction again correlated with a significant increase in the number of $Ly6C^{hi}$ inflammatory monocytes in the spleen (FIG. 8D-E). To further address the potential of IMP therapy in reperfusion injury model, IMP were tested in rodents whereby the renal artery was ligated for 45 minutes with blood flow allowed to return there after. IMP treatment was initiated at 12 hours post ligation. Strikingly, serum creatinine clearance was significantly greater in animals that had been treated with IMP compared to vehicle treated controls at day 1 and day 5 (n), correlated with reduced tubular atrophy scores in treated animals at these time points (o). Overall it is well established that graft failure in transplantation as well as long term outcomes after myocardial infarction are directly correlated to the degree of inflammation and infarction size, respectively (Nahrendorf et al., Circulation 121:2437-2445, 2010; Leuschner et al., J. Exp. Med. 209:123-137, 2012; Nahrendorf, et al., J. Exp. Med. 204:3037-3047, 2007). The data here show strong support that IMP not only reduce inflammation, but more importantly are also associated with increased organ function.

Example 9

IMP Therapy Alleviates Symptoms of Inflammatory Bowel Disease

The gut represents a unique organ system, unlike the brain, peritoneum or the heart. The importance of monocytes in inflammatory bowel disease (IBD) has been described (Bain et al., Mucosal Immunol, 2012; Xu et al., Cell Res. 18:1220-1229, 2008), with the chemokine GM CSF as well as $Ly6C^{hi}$ inflammatory monocytes implicated in the pathogenesis of IBD, using a dextran sodium sulphate (DSS)-induced colitis model (Xu et al., Cell Res. 18:1220-1229, 2008). Reduction in $Ly6C^{hi}$ inflammatory monocyte trafficking into the inflamed colon is proposed to reduce disease severity. As such, IMP treatment (FIG. 5P) in animals with DSS-induced colitis was investigated. Colitic symptoms were significantly diminished in animals that were treated with PS-IMP, compared to vehicle controls (FIG. 5G). Furthermore, there was a reduction in the number of $GR1^+$ cells with monocytic morphology into the inflamed colon, as determined by immunohistochemistry (FIG. 5R-S). This correlated with reduced epithelial disruption and significantly increased numbers of epithelial cells labelling with the proliferation marker, Ki67, in PS-IMP-treated animals (FIG. 8F-G). Epithelial proliferation is associated with intestinal recovery following DSS challenge, with the infusion of IMP evidently enabling early repair of DSS-mediated damage.

Example 10

IMP Therapy Protects from Inflammatory Damage in a Myocardial Infarction Model Using the permanent left anterior descending artery occlusion model (Yeap et al., Methods in Molecular Biology, In Press), the impact of 4 days of naked PLGA-IMP treatment (FIG. 9) was determined. In vehicle-treated animals, occlusion resulted in an increase in inflammation. IMP treatment significantly reduced the size of the inflammatory focus, reducing overall cardiac inflammation. Furthermore, a significant reduction in CD68+ macrophage numbers within the infarct area was observed, with IMP treatment resulting in a reduction in the number of CD68+ cells/mm², relative to the vehicle-treated control. Importantly, this reduction area which correlated with a significant increase in the number of Ly6C$^{hi}$ inflammatory monocytes in the spleen.

To further address the potential of IMP therapy in a myocardial ischemia (LAD occlusion)-reperfusion model, IMP were tested in rodents whereby the left anterior descending coronary artery was occluded and then released 30 minutes later. IMP treatment was initiated at 24 hours post ligation and continued for 4 days. As shown in FIG. 10, at 28 days post IR, the infarct scar size in the treated animals was reduced by 45% compared with the PBS-treated animals. Additionally, the systolic ejection fraction in the PLG-IMP treated animals was increased by 21% compared to the control animals.

These data in the preceding examples indicate that IMP can successfully be utilized in a wide variety of infectious and non-infectious inflammatory disorders to reduce inflammatory monocyte trafficking to the site of inflammation. This results in significantly reduced clinical disease symptoms and may also enable repair mechanisms to be initiated, which might otherwise be inhibited by the pro-inflammatory milieu generated by inflammatory monocytes.

Example 11

Preparation of Negatively Charged Immune Modifying Particles (IMPs)

To a solution of Poly(ethylene-maleic anhydride) (PEMA) in $D_2O$ (4 mL, 1% w/v) was added dropwise a solution of poly(lactide-co-glycolic acid) (PLG) in dichloromethane (DCM) (2 mL, 20% w/v). The mixture was allowed to sonicate on ice at 16 watts for 30 sec using the VC 30 Ultrasonic Processor. The resulting homogenized crude was then poured into a solution of $D_2O$ (200 mL containing 0.5% w/v of PEMA). The homogenized slurry was allowed to stir overnight at speed setting of 3.5 using Bellco Glass, Inc., Bellstir Multi-stir 9 magnetic stirrer (10 W for 10 s, 16 W for 10 s, 16 W for 30 s).

Results

After three hours of stirring, particle size analyses were performed using dynamic light scattering in disposable polystyrene cuvettes
 a. 10 W, 10 s–Z-average=499.9 nm–PdI=0.23, Peak=634.5 nm
 b. 16 W, 10 s–Z-average=528.9 nm–PdI=0.227, Peak=657.5 nm
 c. 16 W, 30 s–Z-average=471.6 nm–PdI=0.228, Peak=580.5 nm
 d. 16 W, 60 s–Z-average=491.1 nm–PdI=0.275, Peak=600.8 nm After the reaction was complete, the resulting crude suspension was then purified.

Purification

Fresh $D_2O$ and 10× sodium bicarbonate buffer were chilled overnight to 4° C. Using a 40 µm cell strainer, 36 mL of particle suspension were filtered from each batch into an appropriately-labelled 50 mL centrifuge tube containing 4 mL chilled 10× sodium bicarbonate buffer. Each beaker produced approximately 6 such tubes. All tubes were centrifuged for about 15 minutes at 7000 g at 4° C. and the supernatant was aspirated. Preparation of the suspension was repeated using the above-mentioned procedure and much of the particle pellets were suspended as possible in 1 mL chilled $D_2O$.

The resuspended particles were transferred into a fresh tube with 4 mL of chilled 10× sodium bicarbonate buffer. (Step 1)

Resuspension of the particle was repeated until the entire particle pellets have been successfully resuspended. (Step 2)

The 6 centrifugal tubes were then combined into one centrifuge tube (50 mL tube) and the tube was filled with the remaining volume to 40 mL of chilled $D_2O$ (Wash 1).

The tube was centrifuged for 20 minutes at 7000 g at 4° C. and the supernatant was aspirated.

Step 1 and 2 and Wash 1 of the resulting particle were repeated each time at least two more times. Finally, the resulting particle pellets were then subjected to a flash-freeze in liquid nitrogen and lyophilized to dryness in the manifold to obtain negatively IMPs.

FIG. 14 shows characterization of surface-functionalized poly(lactide-co-glycolide) particles by dynamic light scattering analysis. Surface-functionalized poly(lactide-co-glycolide) particles were analysed on a Malvern Zetasizer Nano ZS (Malvern Instruments, Westborough, Mass.) at a count rate of $2.5 \times 10^5$ counts per second in 18.2 MΩ water. The population of surface-functionalized poly(lactide-co-glycolide) particles had a Z-average diameter of 567 nm, a peak diameter of 670 nm and a polydispersity index of 0.209.

Table 4 shows the measurements for surface functionalized PLG-PEMA particles. The data in the table is representative, as each batch is slightly different. The numbers in the table were based on combining several batches of particles though. The measurements for the double emulsion particles are similar to those in Table 3.

TABLE 4

Measurements for the surface functionalized PLG-PEMA particles

| Particle | Z-average size by intensity (nm) | ζ-potential (mV) |
|---|---|---|
| PLG (Phosphorex) | 624.3 | −32.7 ± 4.71 |
| PLG-PEMA | 429.9 | −67.4 ± 10.9 |

Example 12

IMP Induce Regulatory T Cells

Previously, it has been shown that IMP infusion in the MS model, experimental autoimmune encephalomyelitis can inhibit disease. In this model, at day 0, mice are immunized with complete fruends adjuvant and the myelin antigen, proteolipid protein 139-158. Disease symptoms are monitored daily, and when disease onset is evident, IMP treatment for 10 days is conducted. In this example, daily intravenous infusion of biodegradable PLGA-IMP over 10 days from the time of disease onset, both ameliorated disease during treatment and was associated with a post treatment period of 14 days devoid of symptoms (FIG. 15A). Reduced disease scores in animals treated at onset, correlated with increased numbers of C4+CD25+FOXP3+TIM3+ regulatory T cells during treatment (FIGS. 15B and C). At day 20 (10 past treatment initiation), these Tregs express the negative co-stimulatory molecule PD-1 (FIG. 15 B). 10 days post dosing cessation, the number of Tregs was found to be diminished to baseline, which correlated with relapse of disease (FIG. 15A).

Example 13

IMPs Bind to Distinct Proteins in Inflammatory Blood Compared to NaïVe Blood

Mouse plasma was collected by cardiac puncture into hepinarized tubes from Wets Nile Infected or Mock (non-infected) mice. Plasma was subsequently separated from other blood components (eg white and red blood cells) by standard methods well known in the art. Plasma was subsequently incubated with 3×10$^8$ immune modifying nanoparticles for 30 minutes at room temperature. After 30 minutes particles were washed and proteins were separated on SDS-PAGE gels and each lane cut into 12 equal gel slices. Slices were subjected to trypsin digest and the resulting peptide mixtures analyzed by reversed phase liquid chromatography coupled to tandem mass spectrometry (LC-MS/MS). Proteins were subject to GeLC-MS analysis. Briefly, proteins were reduced and alkylated in the presence of dithiothreitol and iodoacetamide. Bands were dried by vacuum centrifugation and incubated with 240 ng trypsin for 1 hour at 4° C. Excess trypsin was removed and replaced with 50 mM ammonium bicarbonate for incubation at 37° C. overnight. Prior to mass spectrometric analysis peptides were concentrated and desalted with the use of pre-fabricated micro-columns containing Poros R2 resin (Perseptive Biosystems, Framingham Mass.). Peptides eluted were resolublized in 0.1% formic acid and subject to reverse phase LC-MS/MS. Approximately 41,000 MS/MS spectra were generated from replicate LC-MS/MS experiments. Tandem mass spectra were extracted, charge state deconvoluted and deisotoped in Mascot and analyzed using Mascot and X!Tandem. Data were searched against *Mus musculus* (mouse) entries included in the SWISS-PROT databases with the significance threshold set at p<0.05. Searches were conducted with a fragment ion mass tolerance of 15 ppm and a parent ion tolerance of 0.2 Da. Methionine sulfoxide, carbamidomethyl-cysteine and deamidated asparagine and glutamine were specified as variable modifications. Scaffold was used integrate multiple MS/MS experiments and validate MS/MS based peptides and protein identifications. Peptides were considered only if Mascot ion scores exceeded 30, 40 and 40 for doubly, triply and quadruply charged peptides respectively. X!Tandem identifications required −Log (Expect scores) scores greater than 2.0. Protein identifications were accepted if a minimum of 2 peptides were identified matching the above criteria. Five proteins were considered identified although only matching one peptide. In this case, the peptides were sequenced on multiple occasions and sequence coverage obtained by the single peptide was greater than 5%.

The results of these studies identified the following proteins bound to particles incubated with naïve serum:

TABLE 5

Proteins that bind IMP in naïve serum

| Identified Proteins | SWISSProt Accession Number | Gene Name | pI | Molecular Weight | Unique Peptides Identified | % Sequence Coverage |
|---|---|---|---|---|---|---|
| 14-3-3 protein zeta/delta | 1433Z_MOUSE | Ywhaz | 4.73 | 28 kDa | 3 | 12% |
| Protein 4.1 | 41_MOUSE | Epb41 | 5.43 | 96 kDa | 4 | 6.10% |
| Alpha-1-antitrypsin 1-1 | A1AT1_MOUSE | Serpina 1a | 5.44 | 46 kDa | 3 | 4.60% |
| Actin, cytoplasmic 1 | ACTB_MOUSE | Actb | 5.29 | 42 kDa | 11 | 39% |
| Alpha-actinin-1 | ACTN1_MOUSE | Actn1 | 5.23 | 103 kDa | 2 | 2.50% |
| Alpha-adducin | ADDA_MOUSE | Add1 | 5.62 | 81 kDa | 2 | 3.10% |
| ADP/ATP translocase 1 | ADT1_MOUSE | Slc25a4 | 9.73 | 33 kDa | 2 | 8.10% |
| Serum albumin | ALBU_MOUSE | Alb | 5.53 | 69 kDa | 14 | 29% |
| Ankyrin-1 | ANK1_MOUSE | Ank1 | 6.09 | 204 kDa | 5 | 3.30% |
| Annexin A2 | ANXA2_MOUSE | Anxa2 | 7.53 | 39 kDa | 6 | 20% |
| Annexin A5 | ANXA5_MOUSE | Anxa5 | 4.82 | 36 kDa | 3 | 9.40% |
| Acylamino-acid-releasing enzyme | APEH_MOUSE | Apeh | 5.36 | 82 kDa | 4 | 6.10% |
| Apolipoprotein A-I | APOA1_MOUSE | Apoa1 | 5.31 | 31 kDa | 6 | 21% |
| Apolipoprotein A-IV | APOA4_MOUSE | Apoa4 | 5.21 | 45 kDa | 2 | 7.10% |
| Apolipoprotein C-IV | APOC4_MOUSE | Apoc4 | 9.23 | 14 kDa | 2 | 16% |
| Apolipoprotein E | APOE_MOUSE | Apoe | 5.46 | 36 kDa | 12 | 38% |
| Beta-2-glycoprotein 1 | APOH_MOUSE | Apoh | 8.62 | 39 kDa | 5 | 19% |
| Sodium/potassium-transporting ATPase subunit alpha-1 | AT1A1_MOUSE | Atp1a1 | 5.27 | 113 kDa | 5 | 5.80% |
| Sarcolasmic/endoplasmic reticulum calcium ATPase 1 | AT2A1_MOUSE | Atp2a1 | 5.13 | 109 kDa | 8 | 10% |
| ATP synthase subunit alpha, mitochondrial | ATPA_MOUSE | Atp5a1 | 8.28 | 60 kDa | 6 | 13% |
| ATP synthase subunit beta, mitochondrial | ATPB_MOUSE | Atp5b | 4.99 | 56 kDa | 7 | 19% |

TABLE 5-continued

Proteins that bind IMP in naïve serum

| Identified Proteins | SWISSProt Accession Number | Gene Name | pI | Molecular Weight | Unique Peptides Identified | % Sequence Coverage |
|---|---|---|---|---|---|---|
| Band 3 anion transport protein | B3AT_MOUSE | Slc4a1 | 5.31 | 103 kDa | 11 | 16% |
| Flavin reductase (NADPH) | BLVRB_MOUSE | Blvrb | 6.47 | 22 kDa | 6 | 46% |
| Complement C1q subcomponent subunit A | C1QA_MOUSE | C1qa | 9.48 | 26 kDa | 4 | 21% |
| Complement C1q subcomponent subunit B | C1QB_MOUSE | C1qb | 8.34 | 27 kDa | 6 | 27% |
| Complement C1q subcomponent subunit C | C1QC_MOUSE | C1qc | 8.88 | 26 kDa | 4 | 16% |
| C-1-tetrahydrofolate synthase, cytoplasmic | C1TC_MOUSE | Mthfd1 | 6.73 | 101 kDa | 4 | 5.50% |
| C4b-binding protein | C4BPA_MOUSE | C4bpa | 5.97 | 52 kDa | 4 | 12% |
| Carbonic anhydrase 1 | CAH1_MOUSE | Ca1 | 6.47 | 28 kDa | 4 | 20% |
| Carbonic anhydrase 2 | CAH2_MOUSE | Ca2 | 6.48 | 29 kDa | 6 | 37% |
| Catalase | CATA_MOUSE | Cat | 7.72 | 60 kDa | 7 | 17% |
| Clathrin heavy chain 1 | CLH1_MOUSE | Cltc | 5.48 | 192 kDa | 8 | 6.20% |
| Complement C3 | CO3_MOUSE | C3 | 6.3 | 186 kDa | 30 | 22% |
| Cofilin-1 | COF1_MOUSE | Cfl1 | 8.26 | 19 kDa | 1 | 6.60% |
| Uroporphyrinogen decarboxylase | DCUP_MOUSE | Urod | 6.21 | 41 kDa | 3 | 9.00% |
| Desmoplakin | DESP_MOUSE | Dsp | 6.43 | 333 kDa | 2 | 0.80% |
| Elongation factor 1-alpha 1 | EF1A1_MOUSE | Eef1a1 | 9.1 | 50 kDa | 6 | 16% |
| Elongation factor 1-delta | EF1D_MOUSE | Eef1d | 4.91 | 31 kDa | 2 | 8.50% |
| Elongation factor 2 | EF2_MOUSE | Eef2 | 6.42 | 95 kDa | 4 | 4.50% |
| 55 kDa erythrocyte membrane protein | EM55_MOUSE | Mpp1 | 6.72 | 52 kDa | 3 | 7.50% |
| Alpha-enolase | ENOA_MOUSE | Eno1 | 6.36 | 47 kDa | 2 | 9.70% |
| Endoplasmin | ENPL_MOUSE | Hsp90b1 | 4.72 | 92 kDa | 3 | 5.50% |
| Erythrocyte membrane protein band 4.2 | EPB42_MOUSE | Epb42 | 6.98 | 77 kDa | 2 | 3.30% |
| Ezrin | EZRI_MOUSE | Ezr | 5.83 | 69 kDa | 6 | 10% |
| Coagulation factor V | FA5_MOUSE | F5 | 5.66 | 247 kDa | 4 | 2.60% |
| Alpha-2-HS-glycoprotein | FETUA_MOUSE | Ahsg | 5.94 | 37 kDa | 2 | 9.90% |
| Fibrinogen beta chain | FIBB_MOUSE | Fgb | 3.53 | 55 kDa | 13 | 35% |
| Fibrinogen gamma chain | FIBG_MOUSE | Fgg | 5.55 | 49 kDa | 13 | 34% |
| Fibronectin | FINC_MOUSE | Fn1 | 5.3 | 272 kDa | 31 | 17% |
| Filamin-A | FLNA_MOUSE | Flna | 5.68 | 281 kDa | 15 | 7.50% |
| Glyceraldehyde-3-phosphate dehydrogenase | G3P_MOUSE | Gapdh | 8.45 | 36 kDa | 9 | 37% |
| Gelsolin | GELS_MOUSE | Gsn | 5.72 | 86 kDa | 4 | 8.60% |
| Glutathione peroxidase 3 | GPX3_MOUSE | Gpx3 | 6.38 | 25 kDa | 3 | 18% |
| Histone H2B type 1-B | H2B1B_MOUSE | Hist1h2bb | 10.32 | 14 kDa | 1 | 7.10% |
| H-2 class I histocompatibility antigen, Q10 alpha chain | HA10_MOUSE | H2-Q10 | 5.06 | 37 kDa | 2 | 6.20% |
| Hemoglobin subunit alpha | HBA_MOUSE | Hba | 8.08 | 15 kDa | 6 | 43% |
| Hemoglobin subunit beta-1 | HBB1_MOUSE | Hbb-b1 | 7.26 | 16 kDa | 10 | 74% |
| Delta-aminolevulinic acid dehydratase | HEM2_MOUSE | Alad | 6.31 | 36 kDa | 2 | 6.40% |
| Coproporphyrinogen-III oxidase, mitochondrial | HEM6_MOUSE | Cpox | 6.47 | 50 kDa | 3 | 7.00% |
| Hemopexin | HEMO_MOUSE | Hpx | 7.58 | 51 kDa | 2 | 4.30% |
| Histidine-rich glycoprotein | HRG_MOUSE | Hrg | 7.28 | 59 kDa | 5 | 11% |
| Heat shock protein HSP 90-alpha | HS90A_MOUSE | Hsp90aa1 | 4.93 | 85 kDa | 2 | 4.10% |
| Heat shock protein HSP 90-beta | HS90B_MOUSE | Hsp90ab1 | 4.97 | 83 kDa | 6 | 8.40% |
| Heat shock cognate 71 kDa protein | HSP7C_MOUSE | Hspa8 | 5.37 | 71 kDa | 13 | 24% |

TABLE 5-continued

| Proteins that bind IMP in naïve serum | | | | | | |
|---|---|---|---|---|---|---|
| Identified Proteins | SWISSProt Accession Number | Gene Name | pI | Molecular Weight | Unique Peptides Identified | % Sequence Coverage |
| Eukaryotic initiation factor 4A-I | IF4A1_MOUSE | Eif4a1 | 5.32 | 46 kDa | 2 | 5.70% |
| Ig mu chain C region secreted form | IGHM_MOUSE | Igh-6 | 6.56 | 50 kDa | 13 | 38% |
| Ig kappa chain C region | IGKC_MOUSE | n/a | 5.56 | 11 kDa | 3 | 31% |
| Ubiquitin-like protein ISG15 | ISG15_MOUSE | Isg15 | 8.61 | 18 kDa | 1 | 5.60% |
| Integrin alpha-IIb | ITA2B_MOUSE | Itga2b | 5.43 | 113 kDa | 6 | 8.70% |
| Integrin beta-3 | ITB3_MOUSE | Itgb3 | 5.07 | 87 kDa | 2 | 3.40% |
| Inter alpha-trypsin inhibitor, heavy chain 4 | ITIH4_MOUSE | Itih4 | 5.91 | 105 kDa | 3 | 0.00% |
| Kininogen-1 | KNG1_MOUSE | Kng1 | 6.02 | 73 kDa | 4 | 9.70% |
| Pyruvate kinase isozymes M1/M2 | KPYM_MOUSE | Pkm2 | 7.42 | 58 kDa | 2 | 3.80% |
| L-lactate dehydrogenase A chain | LDHA_MOUSE | Ldha | 7.76 | 36 kDa | 3 | 9.00% |
| Mannose-binding protein C | MBL2_MOUSE | Mbl2 | 4.94 | 26 kDa | 2 | 9.40% |
| Malate dehydrogenase, mitochondrial | MDHM_MOUSE | Mdh2 | 8.55 | 36 kDa | 5 | 18% |
| Myosin regulatory light chain 12B | ML12B_MOUSE | Myl12b | 4.69 | 20 kDa | 4 | 24% |
| Major vault protein | MVP_MOUSE | Mvp | 5.43 | 96 kDa | 5 | 7.80% |
| Myosin-10 | MYH10_MOUSE | Myh10 | 5.43 | 229 kDa | 2 | 3.00% |
| Myosin-9 | MYH9_MOUSE | Myh9 | 5.54 | 226 kDa | 34 | 21% |
| Myosin light polypeptide 6 | MYL6_MOUSE | Myl6 | 4.56 | 17 kDa | 3 | 20% |
| Dihydrolipoyllysine-residue acetyltransferase component of pyruvate dehydrogenase complex | ODP2_MOUSE | Dlat | 5.7 | 68 kDa | 2 | 5.10% |
| Protein disulfide-isomerase A3 | PDIA3_MOUSE | Pdia3 | 5.69 | 57 kDa | 3 | 6.10% |
| Plasminogen | PLMN_MOUSE | Plg | 6.18 | 91 kDa | 10 | 20% |
| Purine nucleoside phosphorylase | PNPH_MOUSE | Pnp | 5.78 | 32 kDa | 6 | 25% |
| Peptidyl-prolyl cis-trans isomerase A | PPIA_MOUSE | Ppia | 7.88 | 18 kDa | 3 | 22% |
| Peroxiredoxin-1 | PRDX1_MOUSE | Prdx1 | 8.26 | 22 kDa | 1 | 5.50% |
| Peroxiredoxin-2 | PRDX2_MOUSE | Prdx2 | 5.2 | 22 kDa | 6 | 32% |
| Peroxiredoxin-6 | PRDX6_MOUSE | Prdx6 | 5.72 | 25 kDa | 3 | 15% |
| GTP-binding nuclear protein Ran | RAN_MOUSE | Ran | 7.2 | 24 kDa | 2 | 9.70% |
| Ras-related protein Rap-1b | RAP1B_MOUSE | Rap1b | 5.65 | 21 kDa | 1 | 5.40% |
| Ubiquitin-60S ribosomal protein L40 | RL40_MOUSE | Uba52 | 6.56 | 15 kDa | 3 | 27% |
| 60S acidic ribosomal protein P0 | RLA0_MOUSE | Rplp0 | 5.91 | 34 kDa | 4 | 20% |
| 40S ribosomal protein SA | RSSA_MOUSE | Rpsa | 4.8 | 33 kDa | 2 | 11% |
| Selenium-binding protein 1 | SBP1_MOUSE | Selenbp1 | 5.87 | 53 kDa | 3 | 6.60% |
| Spectrin alpha chain, erythrocyte | SPTA1_MOUSE | Spta1 | 4.94 | 280 kDa | 19 | 9.60% |
| Spectrin beta chain, erythrocyte | SPTB1_MOUSE | Sptb | 5.19 | 245 kDa | 14 | 8.10% |
| Transgelin-2 | TAGL2_MOUSE | Tagln2 | 8.44 | 22 kDa | 2 | 11% |
| Tubulin alpha-1B chain | TBA1C_MOUSE | Tuba1b | 4.96 | 50 kDa | 9 | 27% |
| Tubulin alpha-4A chain | TBA4A_MOUSE | Tuba4a | 4.93 | 50 kDa | 2 | 21% |
| Tubulin beta-1 chain | TBB1_MOUSE | Tubb1 | 4.96 | 50 kDa | 3 | 15% |
| Tubulin beta-4B chain | TBB4B_MOUSE | Tubb4b | 4.79 | 50 kDa | 11 | 30% |
| Tubulin beta-5 chain | TBB5_MOUSE | Tubb5 | 4.78 | 50 kDa | 2 | 24% |
| Transitional endoplasmic reticulum ATPase | TERA_MOUSE | Vcp | 5.14 | 89 kDa | 4 | 6.20% |
| Transferrin receptor protein 1 | TFR1_MOUSE | Tfrc | 6.13 | 86 kDa | 11 | 18% |
| Talin-1 | TLN1_MOUSE | Tln1 | 5.84 | 270 kDa | 16 | 8.20% |
| Serotransferrin | TRFE_MOUSE | Tf | 6.81 | 77 kDa | 3 | 4.60% |
| Thrombospondin-1 | TSP1_MOUSE | Thbs1 | 4.71 | 130 kDa | 3 | 2.60% |

TABLE 5-continued

Proteins that bind IMP in naïve serum

| Identified Proteins | SWISSProt Accession Number | Gene Name | pI | Molecular Weight | Unique Peptides Identified | % Sequence Coverage |
|---|---|---|---|---|---|---|
| Ubiquitin-like modifier-activating enzyme 1 | UBA1_MOUSE | Uba1 | 5.43 | 118 kDa | 2 | 3.10% |
| Ubiquitin-conjugating enzyme E2 O | UBE2O_MOUSE | Ube2o | 4.94 | 141 kDa | 3 | 3.50% |
| Fermitin family homolog 3 | URP2_MOUSE | Fermt3 | 6.6 | 76 kDa | 4 | 8.10% |
| Vinculin | VINC_MOUSE | Vcl | 5.77 | 117 kDa | 10 | 11% |
| Vitronectin | VTNC_MOUSE | Vtn | 5.56 | 55 kDa | 7 | 17% |

Interestingly, however, these methods identified 15 unique proteins that bind to IMP under inflammatory conditions that are not found bound to IMP under non-inflammatory or naïve conditions. Those proteins are listed in Table 6.

TABLE 6

Proteins that bind IMP in inflammatory serum only

| Unique Protein | Accession Number |
|---|---|
| Actin, muscle-Pisaster ochraceus (Sea star) | ACTM_PISOC |
| Annexin A1 (Annexin I) (Lipocortin I) (Calpactin II) (Chromobindin-9) (p 35) (Phospholipase A2 inhibitory protein)-Homo sapiens (Human) | ANXA1_HUMAN (+1) |
| ATP synthase subunit beta, mitochondrial precursor (EC 3.6.3.14)-Schizosaccharomyces pombe (Fission yeast) | ATPB_SCHPO |
| Fatty acid-binding protein, epidermal (E-FABP) (Psoriasis-associated fatty acid binding protein homolog) (PA-FABP)-Homo sapiens (Human) | FABPE_HUMAN |
| Filaggrin-Homo sapiens (Human) | FILA_HUMAN |
| Heat-shock protein beta-1 (HspB1) (Heat shock 27 kDa protein) (HSP 27) (Stress-responsive protein 27) (SRP27) (Estrogen-regulated 24 kDa protein) (28 kDa heat shock protein)-Homo sapiens (Human) | HSPB1_HUMAN |
| Histone H2A type 1-B-Homo sapiens (Human) | H2A1B_HUMAN (+36) |
| Junction plakoglobin (Desmoplakin-3) (Desmoplakin III)-Bos taurus (Bovine) | PLAK_BOVIN (+3) |
| Parotid secretory protein precursor (PSP)-Mus musculus (Mouse) | PSP_MOUSE |
| Protein S100-A11 (S100 calcium-binding protein A11) (Protein S100C) (Calgizzarin) (MLN 70)-Homo sapiens (Human) | S10AB_HUMAN (+3) |
| Protein S100-A7 (S100 calcium-binding protein A7) (Psoriasin)-Homo sapiens (Human) | S10A7_HUMAN |
| Protein S100-A8 (S100 calcium-binding protein A8) (Calgranulin-A) (Migration inhibitory factor-related protein 8) (MRP-8) (Cystic fibrosis antigen) (CFAG) (P8) (Leukocyte L1 complex light chain) (Calprotectin L1L subunit) (Urinary stone protein band A)-Homo sapiens (Human) | S10A8_HUMAN |
| Protein S100-A9 (S100 calcium-binding protein A9) (Calgranulin-B) (Migration inhibitory factor-related protein 14) (MRP-14) (P14) (Leukocyte L1 complex heavy chain) (Calprotectin L1H subunit)-Homo sapiens (Human) | S10A9_HUMAN |
| Serum albumin precursor (Allergen Bos d 6) (BSA)-Bos taurus (Bovine) | ALBU_BOVIN |
| Ubiquitin cross-reactive protein precursor (Interferon-stimulated protein 15) (IP17)-Mus musculus (Mouse) | UCRP_MOUSE |

These results indicate that the particles of the present invention are useful in both acting as a sink to mop up inflammatory mediators, pathological proteins and/or cellular debris such as S100 proteins and/or fatty acid binding protein for example, for example (FIG. 16A), while also being useful in concentrating regulatory proteins such as Annexin 1 (FIG. 16B). Additionally, these results are useful in the diagnostic methods described herein where serum is incubated with IMP either in vitro or in vivo, and proteins are subsequently purified from the IMP by liquid chromatography, mass spectrometry, HPLC or immunoprecipitation, for example, in order to determine/diagnose the presence of an inflammatory immune response in a subject (FIG. 17).

While specific embodiments of the invention have been described and illustrated, such embodiments should be considered illustrative of the invention only and not as limiting the invention as construed in accordance with the accompanying claims.

All patents, applications, and other references cited herein are incorporated by reference in their entireties.

SEQUENCE LISTING (5140 sequences)

SEQ ID NO: 1 - protein, 21 aa, Mus musculus
MEVGWYRSPFSRVVHLYRNGK

SEQ ID NO: 2 - protein, 9 aa, Homo sapiens
ASFDKAKLK

SEQ ID NO: 3 - protein, 14 aa, Oryctolagus cuniculus
ASQKRPSQRHGSKY

SEQ ID NO: 4 - protein, 20 aa, Homo sapiens
ASQKRPSQRHGSKYLATAST

SEQ ID NO: 5 - protein, 20 aa, Homo sapiens
ATGLCFFGVALFCGCGHEAL

SEQ ID NO: 6 - protein, 20 aa, Homo sapiens
AVPVYIYFNTWTTCQSIAFP

SEQ ID NO: 7 - protein, 9 aa, Human herpesvirus
CLGGLLTMV

SEQ ID NO: 8 - protein, 9 aa, Human herpesvirus
CRVLCCYVL

SEQ ID NO: 9 - protein, 9 aa, Homo sapiens
DAKIRIFDL

SEQ ID NO: 10 - protein, 18 aa, Homo sapiens
DTPYLDITYHFVMQRLPL

SEQ ID NO: 11 - protein, 15 aa, Unknown
  epitope involved in multiple sclerosis
ENPVVAFFKNIVTPR

SEQ ID NO: 12 - protein, 15 aa, Unknown
  epitope involved in multiple sclerosis
ENPVVDFFKNIVTPR

SEQ ID NO: 13 - protein, 15 aa, Unknown
  epitope involved in multiple sclerosis
ENPVVHFFANIVTPR

SEQ ID NO: 14 - protein, 17 aa, Unknown
  epitope involved in multiple sclerosis
ENPVVHFFANIVTPRTP

SEQ ID NO: 15 - protein, 15 aa, Homo sapiens
ENPVVHFFKNIVTPR

SEQ ID NO: 16 - protein, 17 aa, Homo sapiens
ENPVVHFFKNIVTPRTP

SEQ ID NO: 17 - protein, 20 aa, Homo sapiens
FGDYKTTICGKGLSATVTGG

SEQ ID NO: 18 - protein, 9 aa, Homo sapiens
FLYGALLLA

SEQ ID NO: 19 - protein, 21 aa, Homo sapiens
FYYTTGAVRQIFGDYKTTICG

SEQ ID NO: 20 - protein, 24 aa, Human herpesvirus
GGDNHGRGRGRGRGRGGGRPGAPG

SEQ ID NO: 21 - protein, 9 aa, Human herpesvirus
GLCTLVAML

SEQ ID NO: 22 - protein, 13 aa, Mus musculus
HCLGKWLGHPDKF

SEQ ID NO: 23 - protein, 18 aa, Mus musculus
IFKLGGRDSRSGSPMARR

SEQ ID NO: 24 - protein, 15 aa, Homo sapiens
ITREEKPAVTAAPKK

SEQ ID NO: 25 - protein, 13 aa, Homo sapiens
IVTPRTPPPSQGK

SEQ ID NO: 26 - protein, 20 aa, Homo sapiens
KGLSATVTGGQKGRGYRGQH

SEQ ID NO: 27 - protein, 14 aa, Homo sapiens
KIFKLGGRDSRSGS

SEQ ID NO: 28 - protein, 20 aa, Homo sapiens
LFCGCGHEALTGTEKLIETY

SEQ ID NO: 29 - protein, 10 aa, Human herpesvirus
LLDFVRFMGV

SEQ ID NO: 30 - protein, 9 aa, Human herpesvirus
LLWTLVVLL

SEQ ID NO: 31 - protein, 20 aa, Homo sapiens
LPRHRDTGILDSIGRFFGGD

SEQ ID NO: 32 - protein, 20 aa, Homo sapiens
LVGAPFASLVATGLCFFGVA

SEQ ID NO: 33 - protein, 20 aa, Homo sapiens
LYGALLLAEGFYTTGAVRQI

SEQ ID NO: 34 - protein, 19 aa, Homo sapiens
MAATYNFAVLKLMGRFTKF

SEQ ID NO: 35 - protein, 13 aa, Human herpesvirus
MDRPRTPPPSYSE

SEQ ID NO: 36 - protein, 9 aa, Human herpesvirus
NLVPMVATV

SEQ ID NO: 37 - protein, 20 aa, Mus musculus
NPVVHFFKNIVTPRTPPPSQ

SEQ ID NO: 38 - protein, 14 aa, Mus musculus
NTWTTCQSIAFPSK

SEQ ID NO: 39 - protein, 20 aa, Homo sapiens
QKGRGSRGQHQAHSLERVCH

SEQ ID NO: 40 - protein, 8 aa, Human herpesvirus
RAKFKQLL

SEQ ID NO: 41 - protein, 9 aa, Human herpesvirus
RPPIFIRRL

SEQ ID NO: 42 - protein, 20 aa, Homo sapiens
SKTSASIGSLCADARMYGVL

SEQ ID NO: 43 - protein, 9 aa, Homo sapiens
SLSRFSWGA

SEQ ID NO: 44 - protein, 9 aa, Human herpesvirus
SVRDRLARL

SEQ ID NO: 45 - protein, 12 aa, Unknown
  epitope involved in multiple sclerosis
SVSVGMKPSPRP

SEQ ID NO: 46 - protein, 15 aa, Human herpesvirus
TGGVYHFVKKHVHES

SEQ ID NO: 47 - protein, 20 aa, Homo sapiens
TGTEKLIETYFSKNYQDYEY

SEQ ID NO: 48 - protein, 10 aa, Human herpesvirus
TPRVTGGGAM

SEQ ID NO: 49 - protein, 20 aa, Homo sapiens
VDAQGTLSKIFKLGGRDSRS

SEQ ID NO: 50 - protein, 13 aa, Cavia porcellus
VHFFKNIVTPRTP

SEQ ID NO: 51 - protein, 9 aa, Homo sapiens
VMAPRTLVL

SEQ ID NO: 52 - protein, 20 aa, Mus musculus
VTPRTPPPSQGKGRGLSLSR

SEQ ID NO: 53 - protein, 9 aa, Homo sapiens
VVHFFKNIV

SEQ ID NO: 54 - protein, 20 aa, Homo sapiens
WTTCQSIAFPSKTSASIGSL

SEQ ID NO: 55 - protein, 23 aa, Human T-cell lymphotrophic virus
IQAIVSSPCHNSLILPPFSLSPV

SEQ ID NO: 56 - protein, 24 aa, Human T-cell lymphotrophic virus
LPPTAPPLLPHSNLDHILEPSIPW

SEQ ID NO: 57 - protein, 20 aa, Human T-cell lymphotrophic virus
PPPYVEPTAPQVLPVMHPHG

SEQ ID NO: 58 - protein, 23 aa, Human T-cell lymphotrophic virus
QGGLCKALQEQCRFPNITNSHVP

SEQ ID NO: 59 - protein, 20 aa, Human T-cell lymphotrophic virus
RASLSTWHVLYSPNVSVPSS

SEQ ID NO: 60 - protein, 10 aa, Homo sapiens
FFKNIVTPRT

SEQ ID NO: 61 - protein, 9 aa, Homo sapiens
FKNIVTPRT

SEQ ID NO: 62 - protein, 11 aa, Cavia porcellus
HFFKNIVTPRT

SEQ ID NO: 63 - protein, 15 aa, Homo sapiens
KGFKGVDAQGTLSKI

SEQ ID NO: 64 - protein, 13 aa, Unknown
  epitope involved in multiple sclerosis
VHFFKNIVTARTP

SEQ ID NO: 65 - protein, 13 aa, Homo sapiens
VVHFFKNIVTPRT

SEQ ID NO: 66 - protein, 9 aa, Human herpesvirus
SQAPLPCVL

SEQ ID NO: 67 - protein, 12 aa, Unknown
  epitope involved in multiple sclerosis
HTQPYAYEARDH

SEQ ID NO: 68 - protein, 15 aa, Bos taurus
FKADEKKFWGKYLYE

SEQ ID NO: 69 - protein, 16 aa, Homo sapiens
HCLGKWLGHPDKFVGI

SEQ ID NO: 70 - protein, 14 aa, Mus musculus
KTTICGKGLSATVT

SEQ ID NO: 71 - protein, 17 aa, Homo sapiens
VDDTQFVRFDSDAASPR

SEQ ID NO: 72 - protein, 22 aa, Mus musculus
EKLIETYFSKNYQDYEYLINVI

SEQ ID NO: 73 - protein, 9 aa, Mus musculus
ASQKRPSQR

SEQ ID NO: 74 - protein, 15 aa, Homo sapiens
DENPVVHFFKNIVTP

SEQ ID NO: 75 - protein, 19 aa, Homo sapiens
DENPVVHFFKNIVTPRTPP

SEQ ID NO: 76 - protein, 26 aa, Homo sapiens
FKGVDAQGTLSKIFKLGGRDSRSGSP

SEQ ID NO: 77 - protein, 18 aa, Homo sapiens
GTEKLIETYFSKNYQDYE

SEQ ID NO: 78 - protein, 16 aa, Homo sapiens
QSIAFPSKTSASIGSL

SEQ ID NO: 79 - protein, 25 aa, Homo sapiens
AQGTLSKIFKLGGRDSRSGSPMARR

SEQ ID NO: 80 - protein, 25 aa, Homo sapiens
ASDYKSAHKGLKGVDAQGTLSKIFK

SEQ ID NO: 81 - protein, 31 aa, Homo sapiens
EVGELSRGKLYSLGNGRWMLTLAKNMEVRAI

SEQ ID NO: 82 - protein, 18 aa, Homo sapiens
GFYTTGAVRQIFGDYKTT

SEQ ID NO: 83 - protein, 33 aa, Homo sapiens
GNGRWMLTLAKNMEVRAIFTGYYGKGKPVPTQG

SEQ ID NO: 84 - protein, 20 aa, Homo sapiens
GQFRVIGPRHPIRALVGDEV

SEQ ID NO: 85 - protein, 20 aa, Homo sapiens
HHPARTAHYGSLPQKSHGRT

SEQ ID NO: 86 - protein, 20 aa, Homo sapiens
KNIVTPRTPPPSQGKGRGLS

SEQ ID NO: 87 - protein, 20 aa, Homo sapiens
KYLATASTMDHARHGFLPRH

SEQ ID NO: 88 - protein, 19 aa, Homo sapiens
LSRFSWGAEGQRPGFGYGG

SEQ ID NO: 89 - protein, 21 aa, Homo sapiens
MEVGWYRPPFSRVVHLYRNGK

SEQ ID NO: 90 - protein, 20 aa, Homo sapiens
NTWTTCQSIAFPSKTSASIG

SEQ ID NO: 91 - protein, 20 aa, Homo sapiens
PIRALVGDEVELPCRISPGK

SEQ ID NO: 92 - protein, 12 aa, Unknown
  epitope involved in multiple sclerosis
QKSQRSQAENPV

SEQ ID NO: 93 - protein, 12 aa, Cavia porcellus
QKSQRSQDENPV

SEQ ID NO: 94 - protein, 20 aa, Homo sapiens
QRPGFGYGGRASDYKSAHKG

SEQ ID NO: 95 - protein, 20 aa, Homo sapiens
RHRDTGILDSIGRFFGGDRG

SEQ ID NO: 96 - protein, 20 aa, Homo sapiens
SKIFKLGGRDSRSGSPMARR

SEQ ID NO: 97 - protein, 21 aa, Homo sapiens
SKTSASIGSLCADARMYGVLP

SEQ ID NO: 98 - protein, 21 aa, Homo sapiens
TGTEKLIETYFSKNYQDYEYL

SEQ ID NO: 99 - protein, 13 aa, Unknown
  epitope involved in multiple sclerosis
VHFFRNIVTARTP

SEQ ID NO: 100 - protein, 13 aa, Unknown
  epitope involved in multiple sclerosis
VHFFRNIVTARTP

SEQ ID NO: 101 - protein, 20 aa, Homo sapiens
VVHFFKNIVTPRTPPPSQGK

SEQ ID NO: 102 - protein, 21 aa, Homo sapiens
ASQKRPSQRHGSKYLATASTM

SEQ ID NO: 103 - protein, 44 aa, Homo sapiens
ASQKRPSQRHGSKYLATASTMDHARHGFLPRHRDTGILDSIGRF

SEQ ID NO: 104 - protein, 21 aa, Homo sapiens
ASTMDHARHGFLPRHRDTGIL

SEQ ID NO: 105 - protein, 23 aa, Homo sapiens
AVRQIFGDYKTTICGKGLSATVT

SEQ ID NO: 106 - protein, 19 aa, Homo sapiens
ENPVVHFFKNIVTPRTPPP

SEQ ID NO: 107 - protein, 18 aa, Homo sapiens
GFYTTGAYRQIFGDYLTT

SEQ ID NO: 108 - protein, 20 aa, Homo sapiens
GRASDYKSAHKGFKGVDAQG

SEQ ID NO: 109 - protein, 25 aa, Homo sapiens
GVLPWNAFPGKVCGSNLLSICKTAE

SEQ ID NO: 110 - protein, 12 aa, Unknown
  epitope involved in multiple sclerosis
HLILAPSIRHAP

SEQ ID NO: 111 - protein, 12 aa, Unknown
  epitope involved in multiple sclerosis
HLVMAPSVARGL

SEQ ID NO: 112 - protein, 12 aa, Unknown
  epitope involved in multiple sclerosis
HVQLAPPIALRH

SEQ ID NO: 113 - protein, 12 aa, Unknown
  epitope involved in multiple sclerosis
HVVLAPNVQSPL

SEQ ID NO: 114 - protein, 24 aa, Homo sapiens
HYGSLPQKSHGRTQDENPVVHFFK

SEQ ID NO: 115 - protein, 14 aa, Homo sapiens
KKQSKPVTTPEEIA

SEQ ID NO: 116 - protein, 33 aa, Homo sapiens
KLIETYFSKNYQDYEYLINVIHAFQYVIYGTAS

SEQ ID NO: 117 - protein, 30 aa, Homo sapiens
LATASTMDHARHGFLPRHRDTGILDSIGRF

SEQ ID NO: 118 - protein, 23 aa, Homo sapiens
LTFMIAATYNFAVLKLMGRGTKF

SEQ ID NO: 119 - protein, 20 aa, Bos taurus
MIAATYNFAVLKLMGRGTKF

SEQ ID NO: 120 - protein, 21 aa, Homo sapiens
RHGSKYLATASTMDHARHGFL

SEQ ID NO: 121 - protein, 22 aa, Homo sapiens
SIAFPSKTSASIGSLCADARMY

SEQ ID NO: 122 - protein, 34 aa, Homo sapiens
TGGQKGRGSRGQHQAHSLERVCHCLGKWLGHPDK

SEQ ID NO: 123 - protein, 20 aa, Bos taurus
TTICGKGLSATVTGGQKGRG

SEQ ID NO: 124 - protein, 14 aa, Homo sapiens
VVTEIPKEEKDPGM

SEQ ID NO: 125 - protein, 12 aa, Unknown
  epitope involved in multiple sclerosis
WHAPQTPYWASM

SEQ ID NO: 126 - protein, 12 aa, Unknown
  epitope involved in multiple sclerosis
WHIPPNIGRTFS

SEQ ID NO: 127 - protein, 12 aa, Unknown
  epitope involved in multiple sclerosis
WHQTYTSSLWES

SEQ ID NO: 128 - protein, 12 aa, Unknown
  epitope involved in multiple sclerosis
WHTQPAHVVTPM

SEQ ID NO: 129 - protein, 12 aa, Unknown
  epitope involved in multiple sclerosis
WHTSDPLPPAQP

SEQ ID NO: 130 - protein, 26 aa, Homo sapiens
ALVGDEVELPCRISPGKNATGMELGW

SEQ ID NO: 131 - protein, 7 aa, Unknown
  epitope involved in multiple sclerosis
ARWELNL

SEQ ID NO: 132 - protein, 22 aa, Homo sapiens
AVRQIFGDYKTTICGKGLSATV

SEQ ID NO: 133 - protein, 20 aa, Homo sapiens
DTGILDSIGRFFGGDRGAPK

SEQ ID NO: 134 - protein, 20 aa, Homo sapiens
EKDRFSVNLDVSHFSPEELK

SEQ ID NO: 135 - protein, 7 aa, Unknown
  epitope involved in multiple sclerosis
EPLYGPY

SEQ ID NO: 136 - protein, 20 aa, Homo sapiens
FDTGLSEMRLEKDRFSVNLD

SEQ ID NO: 137 - protein, 26 aa, Homo sapiens
GQFRVIGPRHPIRALVGDEVELPCRI

SEQ ID NO: 138 - protein, 20 aa, Homo sapiens
GSGKDSHHPARTAHYGSLPQ

SEQ ID NO: 139 - protein, 15 aa, Homo sapiens
GSLPQKSHGRTQDEN

SEQ ID NO: 140 - protein, 20 aa, Homo sapiens
GVLTVNGPRKQVSGPERTIP

SEQ ID NO: 141 - protein, 23 aa, Homo sapiens
GWYRPPFSRVVHLYRNGKDQDGD

SEQ ID NO: 142 - protein, 20 aa, Homo sapiens
HGFISREFHRKYRIPADVDP

SEQ ID NO: 143 - protein, 20 aa, Homo sapiens
HGKHEERQDEHGFISREFHR

SEQ ID NO: 144 - protein, 20 aa, Homo sapiens
HLLESDLFPTSTSLSPFYLR

SEQ ID NO: 145 - protein, 25 aa, Homo sapiens
IGEGKVTLRIRNVRFSDEGGFTCFF

SEQ ID NO: 146 - protein, 20 aa, Homo sapiens
KYRIPADVDPLTITSSLSSD

SEQ ID NO: 147 - protein, 7 aa, Unknown
  epitope involved in multiple sclerosis
LATPNPS

SEQ ID NO: 148 - protein, 20 aa, Homo sapiens
LTITSSLSSDGVLTVNGPRK

SEQ ID NO: 149 - protein, 24 aa, Homo sapiens
LYRNGKDQDGDAPEYRGRTELLKD

SEQ ID NO: 150 - protein, 20 aa, Homo sapiens
MDIAIHHPWIRRPFFPFHSP

SEQ ID NO: 151 - protein, 7 aa, Unknown
  epitope involved in multiple sclerosis
PEFAPWA

SEQ ID NO: 152 - protein, 7 aa, Unknown
  epitope involved in multiple sclerosis
PEQPPIH

SEQ ID NO: 153 - protein, 25 aa, Homo sapiens
PEYRGRTELLKDAIGEGKVTLRIRN

SEQ ID NO: 154 - protein, 20 aa, Homo sapiens
PPSFLRAPSWFDTGLSEMRL

SEQ ID NO: 155 - protein, 20 aa, Homo sapiens
PVVHFFKNIVTPRTPPPSQG

SEQ ID NO: 156 - protein, 20 aa, Homo sapiens
QGKGRGLSLSRFSWGAEGQR

SEQ ID NO: 157 - protein, 20 aa, Homo sapiens
QVSGPERTIPITREEKPAVT

SEQ ID NO: 158 - protein, 25 aa, Homo sapiens
RDHSYQEEAAMELKVEDPFYWVSPG

SEQ ID NO: 159 - protein, 25 aa, Homo sapiens
RFSDEGGFTCFFRDHSYQEEAAMEL

SEQ ID NO: 160 - protein, 20 aa, Homo sapiens
RRPFFPFHSPSRLFDQFFGE

SEQ ID NO: 161 - protein, 24 aa, Homo sapiens [sequence omitted]

SEQ ID NO: 162 - protein, 20 aa, Homo sapiens
SRLFDQFFGEHLLESDLFPT

SEQ ID NO: 163 - protein, 20 aa, Homo sapiens
STSLSPFYLRPPSFLRAPSW

SEQ ID NO: 164 - protein, 7 aa, Unknown
  epitope involved in multiple sclerosis
SWYARHT

SEQ ID NO: 165 - protein, 7 aa, Unknown
  epitope involved in multiple sclerosis
SWYARHY

SEQ ID NO: 166 - protein, 7 aa, Unknown
  epitope involved in multiple sclerosis
TIKNTFF

SEQ ID NO: 167 - protein, 14 aa, Homo sapiens
TLSKIFKLGGRDSR

SEQ ID NO: 168 - protein, 7 aa, Unknown
  epitope involved in multiple sclerosis
TPTFMYF

SEQ ID NO: 169 - protein, 7 aa, Unknown
  epitope involved in multiple sclerosis
TSPSVAY

SEQ ID NO: 170 - protein, 7 aa, Unknown
  epitope involved in multiple sclerosis
TTPLTNL

SEQ ID NO: 171 - protein, 13 aa, Homo sapiens
VDAQGTLSKIFKL

SEQ ID NO: 172 - protein, 7 aa, Unknown
  epitope involved in multiple sclerosis
VDHQHPS

SEQ ID NO: 173 - protein, 20 aa, Homo sapiens
VKVLGDVIEVHGKHEERQDE

SEQ ID NO: 174 - protein, 20 aa, Homo sapiens
VSHFSPEELKVKVLGDVIEV

SEQ ID NO: 175 - protein, 7 aa, Unknown
  epitope involved in multiple sclerosis
YAQPSER

SEQ ID NO: 176 - protein, 15 aa, Homo sapiens
AAAQMPAYQELVEEA

SEQ ID NO: 177 - protein, 26 aa, Cavia porcellus
AARTTHYGSLPQKSQRSQDENPVVHF

SEQ ID NO: 178 - protein, 15 aa, Homo sapiens
AGVTLISPFVGRILD

SEQ ID NO: 179 - protein, 19 aa, Homo sapiens
ARRKVAMATTYYFDYWGQG

SEQ ID NO: 180 - protein, 20 aa, Homo sapiens
ARTAHYGSLPQKSHGRTQDE

SEQ ID NO: 181 - protein, 15 aa, Human herpesvirus
ARVAEHPDARLAWAR

SEQ ID NO: 182 - protein, 15 aa, Homo sapiens
ASDLEKIHLDEKSFR

SEQ ID NO: 183 - protein, 20 aa, Homo sapiens
ASGGTFSSFAINWVRQAPGQ

SEQ ID NO: 184 - protein, 19 aa, Homo sapiens
CFYQKKEEDWICCACQKTR

SEQ ID NO: 185 - protein, 15 aa, Homo sapiens
DATTNPSLILAAAQM

SEQ ID NO: 186 - protein, 15 aa, Homo sapiens
DFLTISPKLLGELLQ

SEQ ID NO: 187 - protein, 20 aa, Homo sapiens
DHARHGFLPRHRDTGILDSI

SEQ ID NO: 188 - protein, 15 aa, Homo sapiens
DPGVKSVTKIYNYYK

SEQ ID NO: 189 - protein, 15 aa, Homo sapiens
DQMAVEKLSDGIRKF

SEQ ID NO: 190 - protein, 23 aa, Homo sapiens
DRFSGSKSVSTASLTISGLQAED

SEQ ID NO: 191 - protein, 19 aa, Homo sapiens
DRKYSICKSGCFYQKKEED

SEQ ID NO: 192 - protein, 17 aa, Homo sapiens
DSYTLTEELAYAEIRVK

SEQ ID NO: 193 - protein, 20 aa, Homo sapiens
DYKSAHKGFKGVDAQGTLSK

SEQ ID NO: 194 - protein, 15 aa, Homo sapiens
EAGISKDRILIKLSS

SEQ ID NO: 195 - protein, 21 aa, Homo sapiens
EDTAVYYCARNSGYSISRDVY

SEQ ID NO: 196 - protein, 15 aa, Homo sapiens
EKSFRWLHNEDQMAV

SEQ ID NO: 197 - protein, 17 aa, Homo sapiens
ENLHRTFDPHFLRVPCW

SEQ ID NO: 198 - protein, 20 aa, Homo sapiens
ENPVVHFFKNIVTPRTPPPS

SEQ ID NO: 199 - protein, 22 aa, Homo sapiens
EWMGGIIPIFGAADYAQKFQGR

SEQ ID NO: 200 - protein, 15 aa, Homo sapiens
FDPHFLRVPCWKITL

SEQ ID NO: 201 - protein, 15 aa, Homo sapiens
FGAEILKKIPGRVST

SEQ ID NO: 202 - protein, 15 aa, Homo sapiens
FHAIDEYKPQDATTN

SEQ ID NO: 203 - protein, 15 aa, Measles virus
FIVLSIAYPTLSEIK

SEQ ID NO: 204 - protein, 20 aa, Homo sapiens
FKGVDAQGTLSKIFKLGGRD

SEQ ID NO: 205 - protein, 15 aa, Homo sapiens
FTTVVADTGDFHAID

SEQ ID NO: 206 - protein, 15 aa, Homo sapiens
GELLQDNAKLVPVLS

SEQ ID NO: 207 - protein, 21 aa, Homo sapiens
GFTFSDYYMNWIRQAPGKGLE

SEQ ID NO: 208 - protein, 21 aa, Homo sapiens
GHWGAWMPSSISAFEGTCVSI

SEQ ID NO: 209 - protein, 15 aa, Homo sapiens
GIHCNMTLLFSFAQA

SEQ ID NO: 210 - protein, 15 aa, Human immunodeficiency virus
GIKQLQARVLAVERY

SEQ ID NO: 211 - protein, 15 aa, Homo sapiens
GIRKFAADAVKLERM

SEQ ID NO: 212 - protein, 22 aa, Homo sapiens
GNAKNSLYLQMHSLRAEDTAVY

SEQ ID NO: 213 - protein, 20 aa, Homo sapiens
GRFFGGDRGAPKRGSGKDSH

SEQ ID NO: 214 - protein, 15 aa, Homo sapiens
GRILDWHVANTDKKS

SEQ ID NO: 215 - protein, 15 aa, Homo sapiens
GRVSTEVDARLSFDK

SEQ ID NO: 216 - protein, 20 aa, Homo sapiens
GVDAQGTLSKIFKLGGRDSR

SEQ ID NO: 217 - protein, 19 aa, Homo sapiens
HFSIHCCPPFTFLNSKKEI

SEQ ID NO: 218 - protein, 20 aa, Homo sapiens
HRDTGILDSIGRFFGGDRGA

SEQ ID NO: 219 - protein, 15 aa, Homo sapiens
IKLSSTWEGIQAGKE

SEQ ID NO: 220 - protein, 20 aa, Homo sapiens
IVTPRTPPPSQGKGRGLSLS

SEQ ID NO: 221 - protein, 18 aa, Homo sapiens
KIFKLGGRDSRSGSPMAR

SEQ ID NO: 222 - protein, 16 aa, Homo sapiens
KLERMLTERMFNAENG

SEQ ID NO: 223 - protein, 15 aa, Homo sapiens
KLGGSQEDQIKNAID

SEQ ID NO: 224 - protein, 15 aa, Homo sapiens
KNAIDKLFVLFGAEI

SEQ ID NO: 225 - protein, 15 aa, Homo sapiens
LSFDKDAMVARARRL

SEQ ID NO: 226 - protein, 20 aa, Homo sapiens
LSRFSWGAEGQRPGFGYGGR

SEQ ID NO: 227 - protein, 20 aa, Homo sapiens
LSYSHSDYDLGKRPTKDSYT

SEQ ID NO: 228 - protein, 15 aa, Homo sapiens
LVEEAIAYGRKLGGS

SEQ ID NO: 229 - protein, 26 aa, Homo sapiens
LVGDEVELPCRISPGKNATGMEVGWY

SEQ ID NO: 230 - protein, 25 aa, Homo sapiens
LYRNGKDQDGDQAPEYRGRTELLKD

SEQ ID NO: 231 - protein, 20 aa, Homo sapiens
MASQKRPSQRHGSKYLATAS

SEQ ID NO: 232 - protein, 15 aa, Homo sapiens
MESALDQLKQFTTVV

SEQ ID NO: 233 - protein, 19 aa, Homo sapiens
MSQKPAKEGPRLSKNQKYS

SEQ ID NO: 234 - protein, 15 aa, Homo sapiens
MSSSPVKRQRMESAL

SEQ ID NO: 235 - protein, 15 aa, Human herpesvirus
NPVMERFAAHAGDLV

SEQ ID NO: 236 - protein, 20 aa, Homo sapiens
NSGYSISRDVYWGQGTLVTV

SEQ ID NO: 237 - protein, 23 aa, Homo sapiens
PCRFDFPDELRPAVVHGVHYFNS

SEQ ID NO: 238 - protein, 20 aa, Homo sapiens
PGFGYGGRASDYKSAHKGFK

SEQ ID NO: 239 - protein, 23 aa, Homo sapiens
PPFTFLNSKKEIVDRKYSICKSG

SEQ ID NO: 240 - protein, 20 aa, Homo sapiens
PQKSHGRTQDENPVVHFFKN

SEQ ID NO: 241 - protein, 25 aa, Homo sapiens
PRPEVRPPPAKQRPPQKSKQQPRSS

SEQ ID NO: 242 - protein, 15 aa, Homo sapiens
QAGKELEEQHGIHCN

SEQ ID NO: 243 - protein, 11 aa, Homo sapiens
QFQLVESGGGL

SEQ ID NO: 244 - protein, 22 aa, Homo sapiens
QKYSEHFSIHCCPPFTFLNSKK

SEQ ID NO: 245 - protein, 24 aa, Homo sapiens
QPRSSPLRGPGASRGGSPVKASRF

SEQ ID NO: 246 - protein, 24 aa, Homo sapiens
QQHPGKAPKVMIYDVTKRPSGVPD

SEQ ID NO: 247 - protein, 23 aa, Homo sapiens
QRPPQKSKQQPRSSPLRGPGASR

SEQ ID NO: 248 - protein, 12 aa, Homo sapiens
QSVLTQPRSVSG

SEQ ID NO: 249 - protein, 13 aa, Homo sapiens
QSVLTQSPSASAS

SEQ ID NO: 250 - protein, 20 aa, Homo sapiens
QTWGTGIETVFGGGTKVTVL

SEQ ID NO: 251 - protein, 21 aa, Homo sapiens
RAEDTAVYYCARRKVAMATTY

SEQ ID NO: 252 - protein, 15 aa, Homo sapiens
RARRLIELYKEAGIS

SEQ ID NO: 253 - protein, 20 aa, Homo sapiens
RFSWGAEGQRPGFGYGGRAS

SEQ ID NO: 254 - protein, 20 aa, Homo sapiens
RGSGKDSHHPARTAHYGSLP

SEQ ID NO: 255 - protein, 19 aa, Homo sapiens
RLSKNQKYSEHFSIHCCPP

SEQ ID NO: 256 - protein, 19 aa, Homo sapiens
RPGFGYGGRASDYKSAHKG

SEQ ID NO: 257 - protein, 15 aa, Homo sapiens
SFAQAVACAEAGVTL

SEQ ID NO: 258 - protein, 24 aa, Homo sapiens
SGCFYQKKEEDWICCACQKTRTSR

SEQ ID NO: 259 - protein, 20 aa, Homo sapiens
SKYLATASTMDHARHGFLPR

SEQ ID NO: 260 - protein, 20 aa, Homo sapiens
SQRHGSKYLATASTMDHARH

SEQ ID NO: 261 - protein, 20 aa, Homo sapiens
SVKGRFTISRGNAKNSLYLQ

SEQ ID NO: 262 - protein, 19 aa, Homo sapiens
SYAGGSACVFGTGTKLTVL

SEQ ID NO: 263 - protein, 15 aa, Homo sapiens
TDKKSYEPLEDPGVK

SEQ ID NO: 264 - protein, 19 aa, Homo sapiens
TFLNSKKEIVDRKYSICKS

SEQ ID NO: 265 - protein, 15 aa, Homo sapiens
TGEIKALAGCDFLTI

SEQ ID NO: 266 - protein, 15 aa, Homo sapiens
TIVMGASFRNTGEIK

SEQ ID NO: 267 - protein, 20 aa, Homo sapiens
VIVEMNSSVEAIEGSHVSLL

SEQ ID NO: 268 - protein, 15 aa, Human herpesvirus
VPVLAFDAARLRLLE

SEQ ID NO: 269 - protein, 15 aa, Homo sapiens
VPVLSAKAAQASDLE

SEQ ID NO: 270 - protein, 20 aa, Unknown
  epitope involved in multiple sclerosis
YDENPVVHFFKNIVTPRTPP

SEQ ID NO: 271 - protein, 15 aa, Homo sapiens
YNYYKKFSYKTIVMG

SEQ ID NO: 272 - protein, 15 aa, Homo sapiens
ARTAHYGSLPQKSHG

SEQ ID NO: 273 - protein, 20 aa, Cavia porcellus
ASQKRPSQRHGSKYLATAST

SEQ ID NO: 274 - protein, 38 aa, Homo sapiens
ASQKRPSQRHGSKYLATASTMDHARHGFLPRHRDTGIL

SEQ ID NO: 275 - protein, 17 aa, Human herpesvirus
DAYPCYFFKSACRPRAP

SEQ ID NO: 276 - protein, 17 aa, Homo sapiens
DENPVVHFFKNIVTPRT

SEQ ID NO: 277 - protein, 8 aa, Unknown
  epitope involved in multiple sclerosis
EAGAGGGA

SEQ ID NO: 278 - protein, 12 aa, Bos taurus
EDKGACLLPKIE

SEQ ID NO: 279 - protein, 15 aa, Unknown
  epitope involved in multiple sclerosis
ENPKVHFFKNIVTPR

SEQ ID NO: 280 - protein, 8 aa, Unknown
  epitope involved in multiple sclerosis
EPARSRSR

SEQ ID NO: 281 - protein, 15 aa, Unknown
  epitope involved in multiple sclerosis
EPMTPHQWITLYRSY

SEQ ID NO: 282 - protein, 15 aa, Unknown
  epitope involved in multiple sclerosis
FCPPILPYSAWCPVP

SEQ ID NO: 283 - protein, 20 aa, Mus musculus
GFGYGGRASDYKSAHKGFKG

SEQ ID NO: 284 - protein, 12 aa, Homo sapiens
GKWLGHPDKFVG

SEQ ID NO: 285 - protein, 19 aa, Homo sapiens
GSKYLATASTMDHARHGFL

SEQ ID NO: 286 - protein, 20 aa, Homo sapiens
GSKYLATASTMDHARHGFLP

SEQ ID NO: 287 - protein, 15 aa, Homo sapiens
HHPARTAHYGSLPQK

SEQ ID NO: 288 - protein, 22 aa, Homo sapiens
HHPARTAHYGSLPQKSHGRTQD

SEQ ID NO: 289 - protein, 15 aa, Human papillomavirus
IGGRVHFFKDISPIA

SEQ ID NO: 290 - protein, 11 aa, Homo sapiens
KLSDGIRKFAA

SEQ ID NO: 291 - protein, 16 aa, Homo sapiens
KNIVTPRTPPPSQGKG

SEQ ID NO: 292 - protein, 21 aa, Homo sapiens
KSHGRTQDENPVVHFFKNIVT

SEQ ID NO: 293 - protein, 21 aa, Homo sapiens
KSHGRTQDQDPVVHFFKNIVT

SEQ ID NO: 294 - protein, 9 aa, Homo sapiens
LLFSFAQAV

SEQ ID NO: 295 - protein, 20 aa, Cavia porcellus
MDHARHGFLPRHRDTGILDS

SEQ ID NO: 296 - protein, 15 aa, Unknown
  epitope involved in multiple sclerosis
MPVSRLCIELDWCPP

SEQ ID NO: 297 - protein, 20 aa, Homo sapiens
PSQGKGRGLSLSRFSWGAEG

SEQ ID NO: 298 - protein, 15 aa, Unknown
  epitope involved in multiple sclerosis
RGTQEWTELWVSFRA

SEQ ID NO: 299 - protein, 16 aa, Homo sapiens
SHHPARTAHYGSLPQK

SEQ ID NO: 300 - protein, 15 aa, Unknown
  epitope involved in multiple sclerosis
SRGSHEWAVLFRFYY

SEQ ID NO: 301 - protein, 15 aa, Unknown
  epitope involved in multiple sclerosis
SSAKSHCYAFCSGLP

SEQ ID NO: 302 - protein, 12 aa, Homo sapiens
TCFFRDHSYQEE

SEQ ID NO: 303 - protein, 10 aa, Homo sapiens
TQDENPVVHF

SEQ ID NO: 304 - protein, 18 aa, Homo sapiens
TQDQDPVVHFFKNIVTPR

SEQ ID NO: 305 - protein, 12 aa, Bos taurus
TSVFDKLKHLVD

SEQ ID NO: 306 - protein, 21 aa, Mus musculus
VHFFKNIVTPRTPPPSQGKGR

SEQ ID NO: 307 - protein, 10 aa, Homo sapiens
VVHFFKNIVT

SEQ ID NO: 308 - protein, 15 aa, Homo sapiens
YGSLPQKSHGRTQDQ

SEQ ID NO: 309 - protein, 17 aa, Homo sapiens
YKDSHHPARTAHYGSLP

SEQ ID NO: 310 - protein, 9 aa, Homo sapiens
DYKSAHKGF

SEQ ID NO: 311 - protein, 15 aa, Homo sapiens
GKDSHHPARTAHYGS

SEQ ID NO: 312 - protein, 9 aa, Homo sapiens
KYLATASTM

SEQ ID NO: 313 - protein, 21 aa, Homo sapiens
DENPVVHFFKNIVTPRTPPPS

SEQ ID NO: 314 - protein, 12 aa, Homo sapiens
FFKNIVTPRTPP

SEQ ID NO: 315 - protein, 21 aa, Homo sapiens
TGGQKGRGSRGQHQAHSLERV

SEQ ID NO: 316 - protein, 18 aa, Homo sapiens
YKTTICGKGLSATVTGGQ

SEQ ID NO: 317 - protein, 20 aa, Homo sapiens
GLSLSRFSWGAEGQRPGFGY

SEQ ID NO: 318 - protein, 19 aa, Homo sapiens
APKRGSGKDSHHAARTAHY

SEQ ID NO: 319 - protein, 23 aa, Homo sapiens
DAIGEGKVTLRIRNVRFSDEGGF

SEQ ID NO: 320 - protein, 21 aa, Homo sapiens
DSIGRFFGGDRGAPKRGSGKD

SEQ ID NO: 321 - protein, 20 aa, Homo sapiens
ELPCRISPGKNATGMEVGWY

SEQ ID NO: 322 - protein, 23 aa, Homo sapiens
EYRGRTELLKDAIGEGKVTLRIR

SEQ ID NO: 323 - protein, 20 aa, Homo sapiens
FSWGAEGQRPGFGYGGRASD

SEQ ID NO: 324 - protein, 22 aa, Homo sapiens
GGQKGRGSRGQHQAHSLERVCH

SEQ ID NO: 325 - protein, 15 aa, Herpes simplex virus
GGRRLFFVKAHVRES

SEQ ID NO: 326 - protein, 20 aa, Homo sapiens
GKGRGLSLSRFSWGAEGQRP

SEQ ID NO: 327 - protein, 24 aa, Homo sapiens
GLSLSRFSWGAEGQRPGFGYGGRA

SEQ ID NO: 328 - protein, 23 aa, Homo sapiens
GMEVGWYRPPFSRVVHLYRNGKD

SEQ ID NO: 329 - protein, 22 aa, Homo sapiens
GQFRVIGPRHPIRALVGDEVEL

SEQ ID NO: 330 - protein, 15 aa, Homo sapiens
GTLSKIFKLGGRDSR

SEQ ID NO: 331 - protein, 26 aa, Homo sapiens
GVDAQGTLSKIFKLGGRDSRSGSPMA

SEQ ID NO: 332 - protein, 19 aa, Homo sapiens
HAARTAHYGSLPQKSQGHR

SEQ ID NO: 333 - protein, 17 aa, Homo sapiens
HCLGKWLGHPDKFVGIT

SEQ ID NO: 334 - protein, 15 aa, Homo sapiens
LGHPDKFVGITYALT

SEQ ID NO: 335 - protein, 20 aa, Homo sapiens
LGQGPEFLTYFQNEAQLEKS

SEQ ID NO: 336 - protein, 20 aa, Homo sapiens
LLAEGFYTTGAVRQIFGDYK

SEQ ID NO: 337 - protein, 19 aa, Homo sapiens
NPVVHFFKNIVTPRTPPPS

SEQ ID NO: 338 - protein, 20 aa, Homo sapiens
PQDENPVVHFFKNIVTPRTP

SEQ ID NO: 339 - protein, 20 aa, Homo sapiens
PRHRDTGILDSIGRFFGGDR

SEQ ID NO: 340 - protein, 19 aa, Unknown
  epitope involved in multiple sclerosis
QAHSLERVSHSLGKWLGHP

SEQ ID NO: 341 - protein, 20 aa, Homo sapiens
RDTGILDSIGRFFGGDRGAP

SEQ ID NO: 342 - protein, 20 aa, Homo sapiens
RFFGGDRGAPKRGSGKDSHH

SEQ ID NO: 343 - protein, 20 aa, Homo sapiens
RTAHYGSLPQKSHGRTQDEN

SEQ ID NO: 344 - protein, 20 aa, Homo sapiens
YKSAHKGFKGVDAQGTLSKI

SEQ ID NO: 345 - protein, 25 aa, Homo sapiens
AARTTHYGSLPQKSQRSQDQNPVHF

SEQ ID NO: 346 - protein, 25 aa, Bos taurus
AEYRGRVSLVEDHIAEGSVAVRIQE

SEQ ID NO: 347 - protein, 17 aa, Unknown
  epitope involved in multiple sclerosis
AKPVVHLFANIVTPRTP

SEQ ID NO: 348 - protein, 26 aa, Bos taurus
APFDVIGPQEPILAVVGEDAELPCRL

SEQ ID NO: 349 - protein, 11 aa, Homo sapiens
ASDYKSAHKGF

SEQ ID NO: 350 - protein, 19 aa, Homo sapiens
ASQKRPSQRHGKYLATAST

SEQ ID NO: 351 - protein, 20 aa, Mus musculus
ASQKRPSQRSKYLATASTMD

SEQ ID NO: 352 - protein, 26 aa, Bos taurus
AVVGEDAELPCRLSPNVSAKGMELRW

SEQ ID NO: 353 - protein, 11 aa, Homo sapiens
DENPVVHFFKN

SEQ ID NO: 354 - protein, 17 aa, Homo sapiens
ENPVVHEFKNIVTPRTP

SEQ ID NO: 355 - protein, 14 aa, Homo sapiens
ENPVVHFFKNIVTP

SEQ ID NO: 356 - protein, 15 aa, Unknown
  epitope involved in multiple sclerosis
ENPVVHFFLNIVTPR

SEQ ID NO: 357 - protein, 15 aa, Unknown
  epitope involved in multiple sclerosis
ENPVVHFFRNIVTPR

SEQ ID NO: 358 - protein, 19 aa, Homo sapiens
GLSLSRFSWGAQGQKPGFG

SEQ ID NO: 359 - protein, 23 aa, Homo sapiens
GTLSKIFKLGGRDSRSGSPMARR

SEQ ID NO: 360 - protein, 25 aa, Bos taurus
IAEGSVAVRIQEVKASDDGEYRCFF

SEQ ID NO: 361 - protein, 25 aa, Bos taurus
KASDDGEYRCFFRQDENYEEAIVHL

SEQ ID NO: 362 - protein, 22 aa, Homo sapiens
KSHGRTQDENPVVHFFKNIVTP

SEQ ID NO: 363 - protein, 17 aa, Homo sapiens
LATASTMDHARHGFLPR

SEQ ID NO: 364 - protein, 14 aa, Homo sapiens
NPVVHFFKNIVTPR

SEQ ID NO: 365 - protein, 19 aa, Homo sapiens
QDENPVVHFFKNIVTPRTP

SEQ ID NO: 366 - protein, 20 aa, Bos taurus
RQDENYEEAIVHLKVAALGS

SEQ ID NO: 367 - protein, 23 aa, Bos taurus
RWFREKVSPAVFVSREGQEQEGE

SEQ ID NO: 368 - protein, 24 aa, Bos taurus
SPNVSAKGMELRWFREKVSPAVFV

SEQ ID NO: 369 - protein, 18 aa, Bos taurus
TLSKIFKLGGRDSRSGSP

SEQ ID NO: 370 - protein, 13 aa, Homo sapiens
VHFFKNIVTPRTE

SEQ ID NO: 371 - protein, 24 aa, Bos taurus
VSREGQEQEGEMAEYRGRVSLVED

SEQ ID NO: 372 - protein, 23 aa, Homo sapiens
VTPRTPPPSQGKGRGLSLSRFSW

SEQ ID NO: 373 - protein, 18 aa, Homo sapiens
ALGQGPQFIFQYYEEEER

SEQ ID NO: 374 - protein, 19 aa, Homo sapiens
GLSLSRFSWGAEGQRPGFG

SEQ ID NO: 375 - protein, 19 aa, Homo sapiens
GLSLSRFSWGAEGQRPGFG

SEQ ID NO: 376 - protein, 14 aa, Homo sapiens
HKGFKGVDAQGTLS

SEQ ID NO: 377 - protein, 24 aa, Homo sapiens
KSHGRTQDENPVVHFFKNIVTPRT

SEQ ID NO: 378 - protein, 21 aa, Homo sapiens
LGQGPEFLIYFQGTGAADDSG

SEQ ID NO: 379 - protein, 20 aa, Homo sapiens
LLKDAIGEGKVTLRIRNVRF

SEQ ID NO: 380 - protein, 20 aa, Homo sapiens
QAPEYRGRTELLKDAIGEGK

SEQ ID NO: 381 - protein, 20 aa, Homo sapiens
RDHSYQEEAAMELKVEDPFY

SEQ ID NO: 382 - protein, 20 aa, Homo sapiens
RPPFSRVVHLYRNGKDQDGD

SEQ ID NO: 383 - protein, 20 aa, Homo sapiens
SDEGGFTCFFRDHSYQEEAA

SEQ ID NO: 384 - protein, 20 aa, Homo sapiens
SKIFKLGGRDSRSGSPMARR

SEQ ID NO: 385 - protein, 19 aa, Homo sapiens
SRGQHQAHSLERVCHCLGK

SEQ ID NO: 386 - protein, 20 aa, Homo sapiens
VTLRIRNVRFSDEGGFTCFF

SEQ ID NO: 387 - protein, 20 aa, Homo sapiens
YRNGKDQDGDQAPEYRGRTE

SEQ ID NO: 388 - protein, 9 aa, Homo sapiens
LMWAKIGPV

SEQ ID NO: 389 - protein, 9 aa, Homo sapiens
SLLLELEEV

SEQ ID NO: 390 - protein, 9 aa, Homo sapiens
VLFSSDFRI

SEQ ID NO: 391 - protein, 12 aa, Homo sapiens
APEYRGRTELLK

SEQ ID NO: 392 - protein, 12 aa, Homo sapiens
ATGMEVGWYRPP

SEQ ID NO: 393 - protein, 12 aa, Homo sapiens
DEGGFTCFFRDH

SEQ ID NO: 394 - protein, 12 aa, Homo sapiens
DHSYQEEAAMEL

SEQ ID NO: 395 - protein, 12 aa, Homo sapiens
DPFYWVSPGVLV

SEQ ID NO: 396 - protein, 12 aa, Homo sapiens
EEAAMELKVEDP

SEQ ID NO: 397 - protein, 12 aa, Homo sapiens
ELKVEDPFYWVS

SEQ ID NO: 398 - protein, 12 aa, Homo sapiens
GDEVELPCRISP

SEQ ID NO: 399 - protein, 12 aa, Homo sapiens
GEGKVTLRIRNV

SEQ ID NO: 400 - protein, 12 aa, Homo sapiens
GPRHPIRALVGD

SEQ ID NO: 401 - protein, 12 aa, Homo sapiens
GRTELLKDAIGE

SEQ ID NO: 402 - protein, 12 aa, Homo sapiens
IRALVGDEVELP

SEQ ID NO: 403 - protein, 19 aa, Homo sapiens
KNIVTPRTPPPSQGKGRGL

SEQ ID NO: 404 - protein, 12 aa, Homo sapiens
LKDAIGEGKVTL

SEQ ID NO: 405 - protein, 12 aa, Homo sapiens
LPCRISPGKNAT

SEQ ID NO: 406 - protein, 19 aa, Homo sapiens
MDHARHGFLPRHRDTGILD

SEQ ID NO: 407 - protein, 12 aa, Homo sapiens
NVRFSDEGGFTC

SEQ ID NO: 408 - protein, 12 aa, Homo sapiens
PPFSRVVHLYRN

SEQ ID NO: 409 - protein, 19 aa, Homo sapiens
PSQGKGRGLSLSRFSWGAE

SEQ ID NO: 410 - protein, 12 aa, Homo sapiens
QDGDQAPEYRGR

SEQ ID NO: 411 - protein, 12 aa, Homo sapiens
QFRVIGPRHPIR

SEQ ID NO: 412 - protein, 19 aa, Homo sapiens
QRPGFGYGGRASDYKSAHK

SEQ ID NO: 413 - protein, 12 aa, Homo sapiens
RNGKDQDGDQAP

SEQ ID NO: 414 - protein, 19 aa, Homo sapiens
SKIFKLGGRDSRSGSPMAR

SEQ ID NO: 415 - protein, 19 aa, Homo sapiens
SLPQKSHGRTQDENPVVHF

SEQ ID NO: 416 - protein, 12 aa, Homo sapiens
SPGKNATGMEVG

SEQ ID NO: 417 - protein, 12 aa, Homo sapiens
SSYAGQFRVIGP

SEQ ID NO: 418 - protein, 9 aa, Homo sapiens
SWGAEGQRP

SEQ ID NO: 419 - protein, 10 aa, Homo sapiens
SWGAEGQRPG

SEQ ID NO: 420 - protein, 12 aa, Homo sapiens
TLRIRNVRFSDE

SEQ ID NO: 421 - protein, 12 aa, Homo sapiens
VGWYRPPFSRVV

SEQ ID NO: 422 - protein, 12 aa, Homo sapiens
VVHLYRNGKDQD

SEQ ID NO: 423 - protein, 8 aa, Homo sapiens
WGAEGQRP

SEQ ID NO: 424 - protein, 10 aa, Homo sapiens
WGAEGQRPGF

SEQ ID NO: 425 - protein, 5 aa, Homo sapiens
AAMEL

SEQ ID NO: 426 - protein, 5 aa, Homo sapiens
ADARM

SEQ ID NO: 427 - protein, 5 aa, Homo sapiens
AHRET

SEQ ID NO: 428 - protein, 15 aa, Bacillus subtilis
ALAVLHFYPDKGAKN

SEQ ID NO: 429 - protein, 21 aa, Unknown [sequence omitted]

SEQ ID NO: 430 - protein, 21 aa, Homo sapiens
ALGQGPQFIFQYYEEEERQRG

SEQ ID NO: 431 - protein, 21 aa, Homo sapiens
ASTMDHARHGFLPRHRDTGIL

SEQ ID NO: 432 - protein, 15 aa, Unknown
  epitope involved in multiple sclerosis
DFARVHFIRALHGSG

SEQ ID NO: 433 - protein, 15 aa, Haemophilus influenzae
DFARVHFISALHGSG

SEQ ID NO: 434 - protein, 21 aa, Homo sapiens
DPGHGLRLIHYSYGVKDTDKG

SEQ ID NO: 435 - protein, 21 aa, Homo sapiens
DPGLGLRLIYFSYDVKMKEKG

SEQ ID NO: 436 - protein, 20 aa, Homo sapiens
GNFPDRFSGHQFPNYSSELN

SEQ ID NO: 437 - protein, 19 aa, Homo sapiens
GQGPQFIFQYYEEEERQRG

SEQ ID NO: 438 - protein, 15 aa, Homo sapiens
GRASDYKSAHKGFKG

SEQ ID NO: 439 - protein, 18 aa, Cavia porcellus
GTLSKIFKLGGRDSRSGS

SEQ ID NO: 440 - protein, 5 aa, Homo sapiens
HRTFE

SEQ ID NO: 441 - protein, 5 aa, Homo sapiens
HSYQE

SEQ ID NO: 442 - protein, 6 aa, Homo sapiens
KTGQFL

SEQ ID NO: 443 - protein, 21 aa, Homo sapiens
KTRGQQVTLRCSPKSGHDTVS

SEQ ID NO: 444 - protein, 20 aa, Homo sapiens
LVKRTGEKVFLECVQDMDHE

SEQ ID NO: 445 - protein, 16 aa, Homo sapiens
NALLLGDSALYLCASS

SEQ ID NO: 446 - protein, 24 aa, Cavia porcellus
PARTAHYGSLPQKSGRSQDENPVV

SEQ ID NO: 447 - protein, 18 aa, Homo sapiens
PKSGHDTVSWYQQALGQG

SEQ ID NO: 448 - protein, 19 aa, Homo sapiens
PNYSSELNVNALLLGDSAL

SEQ ID NO: 449 - protein, 40 aa, Homo sapiens
PSQGKGRGLSLSRFSWGAEGQRPGFGYGGRASDYKSAHKG

SEQ ID NO: 450 - protein, 5 aa, Homo sapiens
QAPEY

SEQ ID NO: 451 - protein, 15 aa, Mycobacterium avium
QRCRVHFLRNVLAQV

SEQ ID NO: 452 - protein, 15 aa, Mycobacterium tuberculosis
QRCRVHFMRNLYTAV

SEQ ID NO: 453 - protein, 19 aa, Homo sapiens
QYYEEEERQRGNFPDRFSG

SEQ ID NO: 454 - protein, 16 aa, Homo sapiens
SHGRTQDENPVVHFFK

SEQ ID NO: 455 - protein, 20 aa, Homo sapiens
SKIFKLGGRDSRSGSPMARR

SEQ ID NO: 456 - protein, 21 aa, Homo sapiens
SKKFLKIMFSYNNKELIINET

SEQ ID NO: 457 - protein, 19 aa, Cavia porcellus
SLSRFSWGAEGQKPGFGYG

SEQ ID NO: 458 - protein, 17 aa, Homo sapiens
SWGAEGQRPGFGYGGRA

SEQ ID NO: 459 - protein, 20 aa, Homo sapiens
SWYQQALGQGPQFIFQYYEE

SEQ ID NO: 460 - protein, 22 aa, Homo sapiens
TSGVTQSPHTLIKTRGQQVTLR

SEQ ID NO: 461 - protein, 15 aa, Staphylococcus aureus
VLARLHFYRNDVHKE

SEQ ID NO: 462 - protein, 5 aa, Homo sapiens
VTLRI

SEQ ID NO: 463 - protein, 20 aa, Unknown
  epitope involved in multiple sclerosis
YDENPVVHFFKNIVTPRTPP

SEQ ID NO: 464 - protein, 15 aa, Influenza A virus
YRNLVWFIKKNTRYP

SEQ ID NO: 465 - protein, 20 aa, Homo sapiens
APKRGSGKDSHHPARTAHYG

SEQ ID NO: 466 - protein, 20 aa, Homo sapiens
ASDYKSAHKGFKGVDAQGTL

SEQ ID NO: 467 - protein, 23 aa, Homo sapiens
ATASTMDHARHGFLPRHRDTGIL

SEQ ID NO: 468 - protein, 45 aa, Homo sapiens
FGGDRGAPKRGSGKDSHHPARTAHYGSLPQKSHGRTQDENPVVHF

SEQ ID NO: 469 - protein, 19 aa, Homo sapiens
GAPKRGSGKDSHHPARTAH

SEQ ID NO: 470 - protein, 18 aa, Homo sapiens
GFGYGGRASDYKSAHKGF

SEQ ID NO: 471 - protein, 15 aa, Homo sapiens
HKGFKGVDAQGTLSK

SEQ ID NO: 472 - protein, 20 aa, Homo sapiens
IGRFFGGDRGAPKRGSGKDS

SEQ ID NO: 473 - protein, 12 aa, Cavia porcellus
IVTPRTPPPSQG

SEQ ID NO: 474 - protein, 20 aa, Homo sapiens
LCNMYKKDSHHPARTAHYGS

SEQ ID NO: 475 - protein, 21 aa, Homo sapiens
LDSIGRFFGGDRGAPKRGSGK

SEQ ID NO: 476 - protein, 19 aa, Homo sapiens
LGQGPEFLTYFQNEAQLKS

SEQ ID NO: 477 - protein, 20 aa, Homo sapiens
LPSHARSQPGLCNMYKKDSH

SEQ ID NO: 478 - protein, 19 aa, Homo sapiens
PRHRDTGILDSIGRFFGGD

SEQ ID NO: 479 - protein, 20 aa, Homo sapiens
PRTPPPSQGKGAEGQRPGFG

SEQ ID NO: 480 - protein, 20 aa, Homo sapiens
RGAPKRGSGKVPWLKPGRSP

SEQ ID NO: 481 - protein, 20 aa, Homo sapiens
SLPQKSHGRTQDENPVVHFF

SEQ ID NO: 482 - protein, 20 aa, Homo sapiens
TQDENPVVHFFKNIVTPRTP

SEQ ID NO: 483 - protein, 18 aa, Homo sapiens
TQDQDPBBHFFKNIVTPR

SEQ ID NO: 484 - protein, 20 aa, Homo sapiens
VPWLKPGRSPLPSHARSQPG

SEQ ID NO: 485 - protein, 24 aa, Homo sapiens
VTPRTPPPSQGKGRGLSLSRFSWG

SEQ ID NO: 486 - protein, 19 aa, Homo sapiens
APKRGSGKDSHHPARTAHY

SEQ ID NO: 487 - protein, 27 aa, Homo sapiens
ASQKRPSQRHGSKYLATASTMDHARHG

SEQ ID NO: 488 - protein, 13 aa, Homo sapiens
DPVVHFFKNIVTP

SEQ ID NO: 489 - protein, 19 aa, Homo sapiens
EGQRPGFGYGGRASDYKSA

SEQ ID NO: 490 - protein, 19 aa, Homo sapiens
FFKNIVTPRTPPPSQGKGR

SEQ ID NO: 491 - protein, 43 aa, Homo sapiens
FGGDRGAPKRGSGKDSHHPARTAHYGSLPQKSHGRTQDENPVV

SEQ ID NO: 492 - protein, 12 aa, Mus musculus
FKNIVTPRTPPP

SEQ ID NO: 493 - protein, 40 aa, Homo sapiens
GLSLSRFSWGAEGQRPGFGYGGRASDYKSAHKGFKGVDAQ

SEQ ID NO: 494 - protein, 19 aa, Homo sapiens
GRASDYKSAHKGFKGVDAQ

SEQ ID NO: 495 - protein, 17 aa, Homo sapiens
HHPARTAHYGSLPQKSH

SEQ ID NO: 496 - protein, 19 aa, Homo sapiens
IGRFFGGDRGAPKRGSGKD

SEQ ID NO: 497 - protein, 19 aa, Homo sapiens
KGFKGVDAQGTLSKIFKLG

SEQ ID NO: 498 - protein, 24 aa, Homo sapiens
KNIVTPRTPPPSQGKGRGLSLSRF

SEQ ID NO: 499 - protein, 29 aa, Homo sapiens
KRGSGKDSHHPARTAHYGSLPQKSHGRTQ

SEQ ID NO: 500 - protein, 8 aa, Homo sapiens
LGRAGLTY

SEQ ID NO: 501 - protein, 19 aa, Homo sapiens
LSLSRFSWGAEGQRPGFGY

SEQ ID NO: 502 - protein, 18 aa, Homo sapiens
PGFGYGGRASDYKSAHKG

SEQ ID NO: 503 - protein, 19 aa, Homo sapiens
PPPSQGKGRGLSLSRFSWG

SEQ ID NO: 504 - protein, 33 aa, Oryctolagus cuniculus
PPPSQGKGRGTVLSRFSWGAEGQKPGFGYGGRA

SEQ ID NO: 505 - protein, 17 aa, Homo sapiens
QDENPVVHFFKNIVTPR

SEQ ID NO: 506 - protein, 23 aa, Homo sapiens
QDENPVVHFFKNIVTPRTPPPSQ

SEQ ID NO: 507 - protein, 27 aa, Homo sapiens
RASDYKSAHKGFKGVDAQGTLSKIFKL

SEQ ID NO: 508 - protein, 26 aa, Homo sapiens
RFFGGDRGAPKRGSGKDSHHPARTAH

SEQ ID NO: 509 - protein, 26 aa, Homo sapiens
RGLSLSRFSWGAEGQRPGFGYGGRAS

SEQ ID NO: 510 - protein, 30 aa, Homo sapiens
RHGFLPRHRDTGILDSIGRFFGGDRGAPKR

SEQ ID NO: 511 - protein, 19 aa, Homo sapiens
RHRDTGILDSIGRFFGGDR

SEQ ID NO: 512 - protein, 28 aa, Homo sapiens
RTAHYGSLPQKSHGRTQDENPVVHFFKN

SEQ ID NO: 513 - protein, 17 aa, Homo sapiens
SLPQKSHGRTQDENPVV

SEQ ID NO: 514 - protein, 15 aa, Homo sapiens
SSLGRAGLTYEQYFG

SEQ ID NO: 515 - protein, 31 aa, Homo sapiens
TASTMDHARHGFLPRHRDTGILDSIGRFFGG

SEQ ID NO: 516 - protein, 21 aa, Homo sapiens
AHSLERVCHCLGKWLGHPDKF

SEQ ID NO: 517 - protein, 21 aa, Homo sapiens
AVRQIFGDYKTTICGKGLSAT

SEQ ID NO: 518 - protein, 14 aa, Homo sapiens
CNMYKDSHHPARTA

SEQ ID NO: 519 - protein, 20 aa, Homo sapiens
CQSIAFPSKTSASIGSLCAD

SEQ ID NO: 520 - protein, 21 aa, Homo sapiens
DQAPEYRGRTELLKDAIGEGK

SEQ ID NO: 521 - protein, 20 aa, Homo sapiens
EGKVTLRIRNVRFSDEGGFT

SEQ ID NO: 522 - protein, 21 aa, Homo sapiens
ELKVEDPFYWVSPGVLVLLAV

SEQ ID NO: 523 - protein, 21 aa, Homo sapiens
EVELPCRISPGKNATGMEVGW

SEQ ID NO: 524 - protein, 21 aa, Homo sapiens
EYLINVIHAFQYVIYGTASFF

SEQ ID NO: 525 - protein, 21 aa, Homo sapiens
FFGVALFCGCGHEALTGTEKL

SEQ ID NO: 526 - protein, 19 aa, Homo sapiens
FGGDRGAPKRGSGKVPWLK

SEQ ID NO: 527 - protein, 21 aa, Homo sapiens
FKGVDAQGTLSKIFKLGGRDS

SEQ ID NO: 528 - protein, 21 aa, Homo sapiens
FMIAATYNFAVLKLMGRGTKF

SEQ ID NO: 529 - protein, 19 aa, Homo sapiens
FSRVVHLYRNGKDQDGDQA

SEQ ID NO: 530 - protein, 21 aa, Homo sapiens
FSWGAEGQRPGFGYGGRASDY

SEQ ID NO: 531 - protein, 20 aa, Homo sapiens
GAPKRGSGKDSHHPARTAHY

SEQ ID NO: 532 - protein, 21 aa, Homo sapiens
GCGHEALTGTEKLIETYFSKN

SEQ ID NO: 533 - protein, 21 aa, Homo sapiens
GFLPRHRDTGILDSIGRFFGG

SEQ ID NO: 534 - protein, 21 aa, Homo sapiens
GFTCFFRDHSYQEEAAMELKV

SEQ ID NO: 535 - protein, 21 aa, Homo sapiens
GFYTTGAVRQIFGDYKTTICG

SEQ ID NO: 536 - protein, 21 aa, Homo sapiens
GILDSIGRFFGGDRGAPKRGS

SEQ ID NO: 537 - protein, 21 aa, Homo sapiens
GQFRVIGPRHPIRALVGDEVE

SEQ ID NO: 538 - protein, 21 aa, Homo sapiens
GRGSRGQHQAHSLERVCHCLG

SEQ ID NO: 539 - protein, 21 aa, Homo sapiens
GRSPLPSHARSQPGLCNMYKD

SEQ ID NO: 540 - protein, 20 aa, Homo sapiens
GVLPWNAFPGKVCGSNLLSI

SEQ ID NO: 541 - protein, 21 aa, Homo sapiens
HCLGKWLGHPDKFVGITYALT

SEQ ID NO: 542 - protein, 20 aa, Homo sapiens
HGSKYLATASTMDHARHGFL

SEQ ID NO: 543 - protein, 12 aa, Homo sapiens
HHPARTAHYGSL

SEQ ID NO: 544 - protein, 21 aa, Homo sapiens
HPIRALVGDEVELPCRISPGK

SEQ ID NO: 545 - protein, 21 aa, Homo sapiens
ITVGLVFLCLQYRLRGKLRAE

SEQ ID NO: 546 - protein, 21 aa, Homo sapiens
KGRGLSLSRFSWGAEGQRPGF

SEQ ID NO: 547 - protein, 21 aa, Homo sapiens
KTTICGKGLSATVTGGQKGRG

SEQ ID NO: 548 - protein, 22 aa, Homo sapiens
LDSIGRFFGGDRGAPKRGSGKD

SEQ ID NO: 549 - protein, 21 aa, Homo sapiens
LQYRLRGKLRAEIENLHRTFD

SEQ ID NO: 550 - protein, 21 aa, Homo sapiens
LSKIFKLGGRDSRSGSPMARR

SEQ ID NO: 551 - protein, 21 aa, Homo sapiens
LYGALLLAEGFYTTGAVRQIF

SEQ ID NO: 552 - protein, 21 aa, Homo sapiens
MYKDSHHPARTAHYGSLPQKS

SEQ ID NO: 553 - protein, 21 aa, Homo sapiens
PGFGYGGRASDYKSAHKGFKG

SEQ ID NO: 554 - protein, 21 aa, Homo sapiens
PGKNATGMEVGWYRPPFSRVV

SEQ ID NO: 555 - protein, 16 aa, Homo sapiens
PKRGSGKDSHHPARTA

SEQ ID NO: 556 - protein, 16 aa, Homo sapiens
PKRGSGKVPWLKPGRS

SEQ ID NO: 557 - protein, 21 aa, Homo sapiens
PQKSHGRTQDENPVVHFFKNI

SEQ ID NO: 558 - protein, 21 aa, Homo sapiens
PRTPPPSQGKGRGLSLSRFSW

SEQ ID NO: 559 - protein, 21 aa, Homo sapiens
RAEIENLHRTFDPHFLRVPCW

SEQ ID NO: 560 - protein, 21 aa, Homo sapiens
RNVRFSDEGGFTCFFRDHSYQ

SEQ ID NO: 561 - protein, 21 aa, Homo sapiens
SDYKSAHKGFKGVDAQGTLSK

SEQ ID NO: 562 - protein, 21 aa, Homo sapiens
SGKVPWLKPGRSPLPSHARSQ

SEQ ID NO: 563 - protein, 11 aa, Homo sapiens
SIGRFFGGDRG

SEQ ID NO: 564 - protein, 21 aa, Homo sapiens
SLCADARMYGVLPWNAFPGKV

SEQ ID NO: 565 - protein, 20 aa, Homo sapiens
SYQEEAAMELKVEDPFYWVS

SEQ ID NO: 566 - protein, 21 aa, Homo sapiens
TELLKDAIGEGKVTLRIRNVR

SEQ ID NO: 567 - protein, 20 aa, Homo sapiens
TFDPHFLRVPCWKITLFVIV

SEQ ID NO: 568 - protein, 21 aa, Homo sapiens
TPRTPPPSQGKGAEGQRPGFG

SEQ ID NO: 569 - protein, 21 aa, Homo sapiens
VALIICYNWLHRRLAGQFLEE

SEQ ID NO: 570 - protein, 21 aa, Homo sapiens
VFACSAVPVYIYFNTWTTCQS

SEQ ID NO: 571 - protein, 21 aa, Homo sapiens
VIVPVLGPLVALIICYNWLHR

SEQ ID NO: 572 - protein, 21 aa, Homo sapiens
YFSKNYQDYEYLINVIHAFQY

SEQ ID NO: 573 - protein, 21 aa, Homo sapiens
YIYFNTWTTCQSIAFPSKTSA

SEQ ID NO: 574 - protein, 20 aa, Homo sapiens
YNWLHRRLAGQFLEELRNPF

SEQ ID NO: 575 - protein, 21 aa, Homo sapiens
YRNGKDQDGDQAPEYRGRTEL

SEQ ID NO: 576 - protein, 32 aa, Homo sapiens
AAFVGAAATLVSLLTFMIAATYNFAVLKLMGR

SEQ ID NO: 577 - protein, 14 aa, Mus musculus
ACSAVTVYIYFNTW

SEQ ID NO: 578 - protein, 19 aa, Homo sapiens
ASDYKSAHKGFKGVDAQGT

SEQ ID NO: 579 - protein, 20 aa, Homo sapiens
AVRQIFGDYKTTICGKGLSA

SEQ ID NO: 580 - protein, 16 aa, Mus musculus
DYKTTICGKGLSATVT

SEQ ID NO: 581 - protein, 31 aa, Homo sapiens
FGVALFCGCEVEALTGTEKLIETYFSKNYQD

SEQ ID NO: 582 - protein, 19 aa, Homo sapiens
FKGVDAQGTLSKIFKLGGR

SEQ ID NO: 583 - protein, 14 aa, Mus musculus
FSKNYQDYEYLINV

SEQ ID NO: 584 - protein, 19 aa, Homo sapiens
GLRLIHYSVGAGITDQGEV

SEQ ID NO: 585 - protein, 40 aa, Homo sapiens
GSKYLATASTMDHARHGFLPRHRDTGILDSIGRFFGGDRG

SEQ ID NO: 586 - protein, 32 aa, Homo sapiens
GTASFFFLYGALLLAYGFYTTGAVRQIFGDYK

SEQ ID NO: 587 - protein, 19 aa, Homo sapiens
HHPARTAHYGSLPQKSHGR

SEQ ID NO: 588 - protein, 29 aa, Homo sapiens
IGRFFGGDRGAPKRGSGKDSHHPARTAHY

SEQ ID NO: 589 - protein, 32 aa, Homo sapiens
KGRGSRGQHQAHSLERVCHCLGCWLGHPDKFV

SEQ ID NO: 590 - protein, 32 aa, Homo sapiens
KVCGSNLLSICKTAEFQMTFHLFIAAFVGAAA

SEQ ID NO: 591 - protein, 15 aa, Mus musculus
LFIAAFVGAAATLVS

SEQ ID NO: 592 - protein, 32 aa, Homo sapiens
LGHPDKFVGITYALTVVWLLVFACSAVPVYIY

SEQ ID NO: 593 - protein, 31 aa, Homo sapiens
LLECCARCLVGAPFASLVATGLCFFGVALFC

SEQ ID NO: 594 - protein, 35 aa, Mus musculus
PWNAFPGKVCGSNLLSICKTAEFQMTFHLFIAAFV

SEQ ID NO: 595 - protein, 20 aa, Homo sapiens
QDENPVVHFFKNIVTPRTPP

SEQ ID NO: 596 - protein, 31 aa, Homo sapiens
RQIFGDYKTTCGKGLSATVTGGQKGRGSRGQ

SEQ ID NO: 597 - protein, 32 aa, Homo sapiens
SASIGTLCADARMYGVLPWNAFFGKVCGSNLL

SEQ ID NO: 598 - protein, 32 aa, Homo sapiens
SAVPVYIYFNTWTTCQSIAAPCKTSASIGTLC

SEQ ID NO: 599 - protein, 15 aa, Mus musculus
TVTGGQKGRGSRGQH

SEQ ID NO: 600 - protein, 32 aa, Homo sapiens
YFSKNYQDYEYLINVIHAFQYVIYGTASFFFL

SEQ ID NO: 601 - protein, 12 aa, Homo sapiens
PVVHFFKNIVTP

SEQ ID NO: 602 - protein, 9 aa, Homo sapiens
KVEDPFYWV

SEQ ID NO: 603 - protein, 11 aa, Homo sapiens
PTRAPSGPRPP

SEQ ID NO: 604 - protein, 11 aa, Homo sapiens
RRREGPDRSPR

SEQ ID NO: 605 - protein, 15 aa, Human adenovirus
DFEVVTFLKDVLPEF

SEQ ID NO: 606 - protein, 15 aa, Pseudomonas aeruginosa
DRLLMLFAKDVVSRN

SEQ ID NO: 607 - protein, 15 aa, Unknown
  epitope involved in multiple sclerosis
ENPVVHYFRNIVTPR

SEQ ID NO: 608 - protein, 15 aa, Human herpesvirus
FRQLVHFVRDFAQLL

SEQ ID NO: 609 - protein, 13 aa, Herpes simplex virus
GGRRLFFVKAHVR

SEQ ID NO: 610 - protein, 15 aa, Mammalian orthoreovirus
MARAAFLFKTVGFGG

SEQ ID NO: 611 - protein, 9 aa, Homo sapiens
KLIETYFSK

SEQ ID NO: 612 - protein, 9 aa, Saccharomyces cerevisiae
KLVETYISK

SEQ ID NO: 613 - protein, 21 aa, Homo sapiens
AAGRGLQLLFYSIGIDQISSE

SEQ ID NO: 614 - protein, 21 aa, Homo sapiens
ALGQGPEFLTYFNYEAQPDKS

SEQ ID NO: 615 - protein, 21 aa, Homo sapiens
ALGQGPEFLTYFNYEAQQDKS

SEQ ID NO: 616 - protein, 21 aa, Homo sapiens
ALGQGPEFLTYFQNEAQLDKS

SEQ ID NO: 617 - protein, 21 aa, Homo sapiens
DLGHGLRLIHYSYGVQDTNKG

SEQ ID NO: 618 - protein, 21 aa, Homo sapiens
DLGLGLRLIHYSNTAGTTGKG

SEQ ID NO: 619 - protein, 21 aa, Homo sapiens
DPGEGPVLLIALYKAGELTSN

SEQ ID NO: 620 - protein, 21 aa, Homo sapiens
DPGKGPEFLFTLYSAGEEKEK

SEQ ID NO: 621 - protein, 21 aa, Homo sapiens
DPGKSLESLFVLLSNGAVKQE

SEQ ID NO: 622 - protein, 21 aa, Homo sapiens
DPGMELHLIHYSYGVNSTEKG

SEQ ID NO: 623 - protein, 21 aa, Homo sapiens
DPGMGLKLIYYSVGAGITDKG

SEQ ID NO: 624 - protein, 21 aa, Homo sapiens
DPGMGLRLIHYSVGAGITDQG

SEQ ID NO: 625 - protein, 21 aa, Homo sapiens
DPGMGLRLIHYSVGEGTTAKG

SEQ ID NO: 626 - protein, 21 aa, Homo sapiens
DPGMGLRRIHYSVAAGITDKG

SEQ ID NO: 627 - protein, 21 aa, Homo sapiens
DPGRGPVFLLLIRENEKEKRK

SEQ ID NO: 628 - protein, 21 aa, Homo sapiens
DSKKFLKIMFSYNNKELIINE

SEQ ID NO: 629 - protein, 21 aa, Homo sapiens
DTGRGPVSLTIMTFSENTKSN

SEQ ID NO: 630 - protein, 20 aa, Homo sapiens
EKKAPTFLFMLTSSGIEKKS

SEQ ID NO: 631 - protein, 21 aa, Homo sapiens
ELGKGPQLIIDIRSNVGEKKD

SEQ ID NO: 632 - protein, 21 aa, Homo sapiens
ELGKRPQLIIDIRSNVGEKKD

SEQ ID NO: 633 - protein, 21 aa, Homo sapiens
EPGAGLQLLTYIFSNMDMKQD

SEQ ID NO: 634 - protein, 21 aa, Homo sapiens
EPGEGPVLLVTVVTGGEVKKL

SEQ ID NO: 635 - protein, 21 aa, Homo sapiens
ESGKGPQFIIDIRSNMDKRQG

SEQ ID NO: 636 - protein, 21 aa, Homo sapiens
ETAKTPEALFVMTLNGDEKKK

SEQ ID NO: 637 - protein, 18 aa, Homo sapiens
FPGCAPRLLVKGSKPSQQ

SEQ ID NO: 638 - protein, 21 aa, Homo sapiens
FPGKGPALLIAIRPDVSEKKE

SEQ ID NO: 639 - protein, 22 aa, Homo sapiens
FPKKSLMLMATSNEGSKATYEQ

SEQ ID NO: 640 - protein, 22 aa, Homo sapiens
FPKKSLMQIATSNEGSKATYEQ

SEQ ID NO: 641 - protein, 22 aa, Homo sapiens
FPKQSLMLMATSNEGSKATYEQ

SEQ ID NO: 642 - protein, 19 aa, Homo sapiens
FPSQGPRFIIQGYKTKVTN

SEQ ID NO: 643 - protein, 21 aa, Homo sapiens
GPGQDPQFLISFYEKMQSDKG

SEQ ID NO: 644 - protein, 20 aa, Homo sapiens
HAGEAPTFLSYNVLDGLEEK

SEQ ID NO: 645 - protein, 20 aa, Homo sapiens
HDGGAPTFLSYNGLDGLEET

SEQ ID NO: 646 - protein, 19 aa, Homo sapiens
HPAGAIVSLFMLSSQKKKH

SEQ ID NO: 647 - protein, 22 aa, Homo sapiens
HPNKGLQLLLKYTSAATLVKGI

SEQ ID NO: 648 - protein, 19 aa, Homo sapiens
IHSQGPQYIIHGLKNNETN

SEQ ID NO: 649 - protein, 21 aa, Homo sapiens
ILGQKVEFLVSFYNNEISEKS

SEQ ID NO: 650 - protein, 21 aa, Homo sapiens
KAKKPPELMFVYSYEKLSINE

SEQ ID NO: 651 - protein, 21 aa, Homo sapiens
KHGEAPVFLMILLKGGEQKGH

SEQ ID NO: 652 - protein, 21 aa, Homo sapiens
KHGEAPVFLMILLKGGEQMRR

SEQ ID NO: 653 - protein, 21 aa, Homo sapiens
KLEEELKFLVYFQNEELIQKA

SEQ ID NO: 654 - protein, 21 aa, Homo sapiens
KSSQAPKLLFHYYDKDFNNEA

SEQ ID NO: 655 - protein, 21 aa, Homo sapiens
KSSQAPKLLFHYYNKDFNNEA

SEQ ID NO: 656 - protein, 21 aa, Homo sapiens
KYGEGLIFLMMLQKGGEEKSH

SEQ ID NO: 657 - protein, 19 aa, Homo sapiens
LPSQGPEYVIHGLTSNVNN

SEQ ID NO: 658 - protein, 19 aa, Homo sapiens
NPWGQLINLFYIPSGTKQN

SEQ ID NO: 659 - protein, 21 aa, Homo sapiens
NQNKEFMLLISFQNEQVLQET

SEQ ID NO: 660 - protein, 21 aa, Homo sapiens
NSGRGLVHLILIRSNEREKHS

SEQ ID NO: 661 - protein, 22 aa, Homo sapiens
PPSGELVFLIRRNSFDEQNEIS

SEQ ID NO: 662 - protein, 22 aa, Homo sapiens
PPSRQMILVIRQEAYKQQNATE

SEQ ID NO: 663 - protein, 22 aa, Homo sapiens
PSSGEMIFLIYQGSYDEQNATE

SEQ ID NO: 664 - protein, 21 aa, Homo sapiens
RPGGHPVFLIQLVKSGEVKKQ

SEQ ID NO: 665 - protein, 21 aa, Homo sapiens
SAKKPLELMFVYNFKEQTENN

SEQ ID NO: 666 - protein, 21 aa, Homo sapiens
SAKKPLELMFVYSLEERVENN

SEQ ID NO: 667 - protein, 21 aa, Homo sapiens
SLDQGLQFLIHYYNGEERAKG

SEQ ID NO: 668 - protein, 21 aa, Homo sapiens
SLDQGLQFLIQYYNGEERAKG

SEQ ID NO: 669 - protein, 21 aa, Homo sapiens
TLEEELKFFIYFQNEEIIQKA

SEQ ID NO: 670 - protein, 21 aa, Homo sapiens
TLGQGLQFLFEYFSETQRNKG

SEQ ID NO: 671 - protein, 21 aa, Homo sapiens
TLGQGPEFLTYFQNEAQLEKS

SEQ ID NO: 672 - protein, 16 aa, Homo sapiens
VFLCLQYRLRGKLRAE

SEQ ID NO: 673 - protein, 21 aa, Homo sapiens
VLGQGPQFIFQYYEKEERGRG

SEQ ID NO: 674 - protein, 21 aa, Homo sapiens
VLKNEFKFLVSFQNENVFDET

SEQ ID NO: 675 - protein, 21 aa, Homo sapiens
VMGKEIKFLLHFVKESKQDES

SEQ ID NO: 676 - protein, 21 aa, Homo sapiens
YPAEGPTFLISISSIKDKNED

SEQ ID NO: 677 - protein, 21 aa, Homo sapiens
YPGEGLQLLLKATKADDKGSN

SEQ ID NO: 678 - protein, 22 aa, Homo sapiens
YPNQGLQLLLKYLSGSTLVESI

SEQ ID NO: 679 - protein, 22 aa, Homo sapiens
YPNQGLQLLLKYLSGSTLVKGI

SEQ ID NO: 680 - protein, 22 aa, Homo sapiens
YPNQGLQLLLKYTSAATLVKGI

SEQ ID NO: 681 - protein, 22 aa, Homo sapiens
YPNQGLQLLLKYTSGATLVKGI

SEQ ID NO: 682 - protein, 22 aa, Homo sapiens
YPNQGLQLLLKYTTGATLVKGI

SEQ ID NO: 683 - protein, 22 aa, Homo sapiens
YPNRGLQFLLKYITGDNLVKGS

SEQ ID NO: 684 - protein, 17 aa, Homo sapiens
YPSKPLQLLQRETMENS

SEQ ID NO: 685 - protein, 20 aa, Homo sapiens
YSGKSPELIMFIYSNGDKED

SEQ ID NO: 686 - protein, 18 aa, Homo sapiens
YSRQRLQLLLRHISRESI

SEQ ID NO: 687 - protein, 8 aa, Homo sapiens
ADARMYGV

SEQ ID NO: 688 - protein, 20 aa, Human herpesvirus
DPGEGPSTGPRGQGDGGRRK

SEQ ID NO: 689 - protein, 20 aa, Human herpesvirus
EADYFEYHQEGGPDGEPDVP

SEQ ID NO: 690 - protein, 8 aa, Homo sapiens
EALTGTEK

SEQ ID NO: 691 - protein, 20 aa, Human herpesvirus
GCKGTHGGTGAGAGAGGAGA

SEQ ID NO: 692 - protein, 31 aa, Human herpesvirus
GEADYFEYHQEGGPDGEPDVPPGAIEQGPAD

SEQ ID NO: 693 - protein, 20 aa, Human herpesvirus
GGPDGEPDVPPGAIEQGPAD

SEQ ID NO: 694 - protein, 29 aa, Human herpesvirus
GGPDGEPDVPPGAIEQGPADDPGEGPSTG

SEQ ID NO: 695 - protein, 20 aa, Human herpesvirus
GGRPGAPGGSGSGPRHRDGV

SEQ ID NO: 696 - protein, 20 aa, Human herpesvirus
GNGLGEKGDTSGPEGSGGSG

SEQ ID NO: 697 - protein, 20 aa, Human herpesvirus
GRRPFFHPVGEADYFEYHQE

SEQ ID NO: 698 - protein, 20 aa, Human herpesvirus
GSGPRHRDGVRRPQKRPSCI

SEQ ID NO: 699 - protein, 30 aa, Human herpesvirus
GSGPRHRDGVRRPQKRPSCIGCKGTHGGTG

SEQ ID NO: 700 - protein, 9 aa, Homo sapiens
HARHGFLPR

SEQ ID NO: 701 - protein, 9 aa, Homo sapiens
IICYNWLHR

SEQ ID NO: 702 - protein, 9 aa, Homo sapiens
KLRAEIENL

SEQ ID NO: 703 - protein, 9 aa, Homo sapiens
KQRIKSQER

SEQ ID NO: 704 - protein, 10 aa, Homo sapiens
KRPSQRHGSK

SEQ ID NO: 705 - protein, 10 aa, Homo sapiens
LLAVLPVLLL

SEQ ID NO: 706 - protein, 9 aa, Homo sapiens
LLECCARCL

SEQ ID NO: 707 - protein, 9 aa, Homo sapiens
LQYRLRGKL

SEQ ID NO: 708 - protein, 8 aa, Homo sapiens
LRIRNVRF

SEQ ID NO: 709 - protein, 9 aa, Homo sapiens
LRKFSSLCY

SEQ ID NO: 710 - protein, 20 aa, Human herpesvirus
MSDEGPGTGPGNGLGEKGDT

SEQ ID NO: 711 - protein, 20 aa, Human herpesvirus
PGAIEQGPADDPGEGPSTGP

SEQ ID NO: 712 - protein, 7 aa, Human herpesvirus
PPPGRRP

SEQ ID NO: 713 - protein, 20 aa, Human herpesvirus
PQRRGGDNHGRGRGRGRGRG

SEQ ID NO: 714 - protein, 20 aa, Human herpesvirus
RGRGRGRGRGGGRPGAPGGS

SEQ ID NO: 715 - protein, 20 aa, Human herpesvirus
RRPQKRPSCIGCKGTHGGTG

SEQ ID NO: 716 - protein, 9 aa, Homo sapiens
RTELLKDAI

SEQ ID NO: 717 - protein, 10 aa, Homo sapiens
RVVHLYRNGK

SEQ ID NO: 718 - protein, 20 aa, Human herpesvirus
SGPEGSGGSGPQRRGGDNHG

SEQ ID NO: 719 - protein, 20 aa, Human herpesvirus
SGSPPRRPPPGRRPFFHPVG

SEQ ID NO: 720 - protein, 9 aa, Homo sapiens
SLDVMASQK

SEQ ID NO: 721 - protein, 36 aa, Human herpesvirus
SSQSSSSGSPPRRPPPGRRPFFHPVGEADYFEYHQE

SEQ ID NO: 722 - protein, 9 aa, Homo sapiens
TAHYGSLPQ

SEQ ID NO: 723 - protein, 20 aa, Homo sapiens
LSLSRFSWGAEGQRPGFGYG

SEQ ID NO: 724 - protein, 19 aa, Homo sapiens
AAHLPAEFTPAVHASLDKF

SEQ ID NO: 725 - protein, 15 aa, Homo sapiens
AAVGTSAAPVPSDNH

SEQ ID NO: 726 - protein, 13 aa, Homo sapiens
AEPPPPPPEPARI

SEQ ID NO: 727 - protein, 12 aa, Homo sapiens
AGEYDHLPEQAF

SEQ ID NO: 728 - protein, 11 aa, Homo sapiens
ALMEGGENGPW

SEQ ID NO: 729 - protein, 11 aa, Homo sapiens
ALMLAISHGRQ

SEQ ID NO: 730 - protein, 9 aa, Homo sapiens
ALYSGVHKK

SEQ ID NO: 731 - protein, 15 aa, Homo sapiens
AQVIILNHPGQISAG

SEQ ID NO: 732 - protein, 12 aa, Homo sapiens
ARKLIGDPNLEF

SEQ ID NO: 733 - protein, 10 aa, Homo sapiens
ASSSVLSSPA

SEQ ID NO: 734 - protein, 13 aa, Homo sapiens
ASVDLKNTGREEF

SEQ ID NO: 735 - protein, 14 aa, Homo sapiens
ASVDLKNTGREEFL

SEQ ID NO: 736 - protein, 16 aa, Homo sapiens
ASVDLKNTGREEFLTA

SEQ ID NO: 737 - protein, 10 aa, Homo sapiens
ATALPTGTSK

SEQ ID NO: 738 - protein, 9 aa, Homo sapiens
ATANQIILK

SEQ ID NO: 739 - protein, 9 aa, Homo sapiens
ATIIDILTK

SEQ ID NO: 740 - protein, 9 aa, Homo sapiens
ATVAGVHVK

SEQ ID NO: 741 - protein, 12 aa, Homo sapiens
ATVRQKLQDETN

SEQ ID NO: 742 - protein, 9 aa, Homo sapiens
ATVTPSPVK

SEQ ID NO: 743 - protein, 9 aa, Homo sapiens
AVALPLQTK

SEQ ID NO: 744 - protein, 12 aa, Homo sapiens
AVILPPLSPYFK

SEQ ID NO: 745 - protein, 9 aa, Homo sapiens
AVQRTLLEK

SEQ ID NO: 746 - protein, 9 aa, Homo sapiens
AVTDVIIAK

SEQ ID NO: 747 - protein, 17 aa, Homo sapiens
AVVDKAAEAGGAEEQYG

SEQ ID NO: 748 - protein, 9 aa, Homo sapiens
AVYSHVIQK

SEQ ID NO: 749 - protein, 12 aa, Homo sapiens
AWKRAEAIESSL

SEQ ID NO: 750 - protein, 10 aa, Homo sapiens
CPLSLAAQLD

SEQ ID NO: 751 - protein, 10 aa, Homo sapiens
DESGPSIVHR

SEQ ID NO: 752 - protein, 13 aa, Homo sapiens
DEWVKPKDMLGPK

SEQ ID NO: 753 - protein, 18 aa, Homo sapiens
DFAIVKFTKVLLQYTGHI

SEQ ID NO: 754 - protein, 14 aa, Homo sapiens
DGVIKVFNDMKVRK

SEQ ID NO: 755 - protein, 13 aa, Homo sapiens
DLPSEASASTAGP

SEQ ID NO: 756 - protein, 10 aa, Homo sapiens
DLPWFRTLSW

SEQ ID NO: 757 - protein, 13 aa, Homo sapiens
DLSQVAAISNDLK

SEQ ID NO: 758 - protein, 14 aa, Homo sapiens
DPPLIALDKDAPLR

SEQ ID NO: 759 - protein, 9 aa, Homo sapiens
DTDHYFLRY

SEQ ID NO: 760 - protein, 11 aa, Homo sapiens
DTGILDSIGRF

SEQ ID NO: 761 - protein, 14 aa, Homo sapiens
DVASVQQQRQEQSY

SEQ ID NO: 762 - protein, 15 aa, Homo sapiens
DVGVYRAVTPQGRPD

SEQ ID NO: 763 - protein, 10 aa, Homo sapiens
DVIGDLHQCQ

SEQ ID NO: 764 - protein, 9 aa, Homo sapiens
DVIRLIMQY

SEQ ID NO: 765 - protein, 12 aa, Homo sapiens
EIIEETKVEDEK

SEQ ID NO: 766 - protein, 15 aa, Homo sapiens
EIIVTHFPFDEQNCS

SEQ ID NO: 767 - protein, 10 aa, Homo sapiens
ELINNELSHF

SEQ ID NO: 768 - protein, 17 aa, Homo sapiens
EPGEPEFKYIGNMHGNE

SEQ ID NO: 769 - protein, 15 aa, Homo sapiens
EPNAIVSDGKYHVVR

SEQ ID NO: 770 - protein, 10 aa, Homo sapiens
ERIAGLEQED

SEQ ID NO: 771 - protein, 11 aa, Homo sapiens
ERTAKELDTNT

SEQ ID NO: 772 - protein, 15 aa, Homo sapiens
ESNAIINDGKYHVVR

SEQ ID NO: 773 - protein, 11 aa, Homo sapiens
ETDLLDIRSEY

SEQ ID NO: 774 - protein, 10 aa, Homo sapiens
EVGGEALGRL

SEQ ID NO: 775 - protein, 9 aa, Homo sapiens
FGESLPARF

SEQ ID NO: 776 - protein, 10 aa, Homo sapiens
FGYSNRVVDL

SEQ ID NO: 777 - protein, 13 aa, Homo sapiens
FITADHLIEKLRT

SEQ ID NO: 778 - protein, 12 aa, Homo sapiens
FLGVAYGATRYN

SEQ ID NO: 779 - protein, 14 aa, Homo sapiens
FLSFPTTKTYFPHF

SEQ ID NO: 780 - protein, 12 aa, Homo sapiens
FRDGDILGKYVD

SEQ ID NO: 781 - protein, 11 aa, Homo sapiens
FRDQEGQDVLL

SEQ ID NO: 782 - protein, 10 aa, Homo sapiens
FRELNEALEL

SEQ ID NO: 783 - protein, 12 aa, Homo sapiens
FRIDSVSEGNAG

SEQ ID NO: 784 - protein, 13 aa, Homo sapiens
FSETGAGKHVPRA

SEQ ID NO: 785 - protein, 15 aa, Homo sapiens
FSETGAGKHVPRAVF

SEQ ID NO: 786 - protein, 10 aa, Homo sapiens
FSQFGPIERA

SEQ ID NO: 787 - protein, 10 aa, Homo sapiens
FSVATVQTTW

SEQ ID NO: 788 - protein, 12 aa, Homo sapiens
FTPAVHASLDKF

SEQ ID NO: 789 - protein, 8 aa, Homo sapiens
FTRSLFVN

SEQ ID NO: 790 - protein, 9 aa, Homo sapiens
FVNDIFERI

SEQ ID NO: 791 - protein, 8 aa, Homo sapiens
FVQMMTAK

SEQ ID NO: 792 - protein, 14 aa, Homo sapiens
GHLYREDQTSPAPG

SEQ ID NO: 793 - protein, 16 aa, Homo sapiens
GKVNVDEVGGEALGRL

SEQ ID NO: 794 - protein, 17 aa, Homo sapiens
GKVNVDEVGGEALGRLL

SEQ ID NO: 795 - protein, 14 aa, Homo sapiens
GNRIAQWQSFQLEG

SEQ ID NO: 796 - protein, 10 aa, Homo sapiens
GRTLQNTMVN

SEQ ID NO: 797 - protein, 12 aa, Homo sapiens
GRTTGIVMDSGD

SEQ ID NO: 798 - protein, 9 aa, Homo sapiens
GTADVHFER

SEQ ID NO: 799 - protein, 9 aa, Homo sapiens
GTFGGLGSK

SEQ ID NO: 800 - protein, 9 aa, Homo sapiens
GTINIVHPK

SEQ ID NO: 801 - protein, 10 aa, Homo sapiens
GVIDVITKTW

SEQ ID NO: 802 - protein, 17 aa, Homo sapiens
GWSSHPPPSPCREQEIR

SEQ ID NO: 803 - protein, 15 aa, Homo sapiens
HGSKYLATASTMDHA

SEQ ID NO: 804 - protein, 9 aa, Homo sapiens
HIILVLSGK

SEQ ID NO: 805 - protein, 9 aa, Homo sapiens
HSERHVLLY

SEQ ID NO: 806 - protein, 9 aa, Homo sapiens
IFANAHTYH

SEQ ID NO: 807 - protein, 8 aa, Homo sapiens
IFEKSFVN

SEQ ID NO: 808 - protein, 11 aa, Homo sapiens
IIEETKVEDEK

SEQ ID NO: 809 - protein, 9 aa, Homo sapiens
IIYKGGTSR

SEQ ID NO: 810 - protein, 9 aa, Homo sapiens
IPMGKSMLV

SEQ ID NO: 811 - protein, 10 aa, Homo sapiens
IPNKNRAEQL

SEQ ID NO: 812 - protein, 13 aa, Homo sapiens
IREADIDGDGQVN

SEQ ID NO: 813 - protein, 12 aa, Homo sapiens
IRETSLDTKSVS

SEQ ID NO: 814 - protein, 12 aa, Homo sapiens
ISKLSAKFGGQA

SEQ ID NO: 815 - protein, 16 aa, Homo sapiens
ISKQEYDESGPSIVHR

SEQ ID NO: 816 - protein, 17 aa, Homo sapiens
ISKQEYDESGPSIVHRK

SEQ ID NO: 817 - protein, 17 aa, Homo sapiens
ISWYDNEFGYSNRVVDL

SEQ ID NO: 818 - protein, 13 aa, Homo sapiens
ITANATEPQKAEN

SEQ ID NO: 819 - protein, 12 aa, Homo sapiens
ITQNGDYQLRTQ

SEQ ID NO: 820 - protein, 14 aa, Homo sapiens
ITSIVKDSSAARNG

SEQ ID NO: 821 - protein, 9 aa, Homo sapiens
IVAGTLTNK

SEQ ID NO: 822 - protein, 16 aa, Homo sapiens
IVTPRTPPPSQGKGRG

SEQ ID NO: 823 - protein, 18 aa, Homo sapiens
IVTPRTPPPSQGKGRGLS

SEQ ID NO: 824 - protein, 11 aa, Homo sapiens
IVVYPVHGFMY

SEQ ID NO: 825 - protein, 9 aa, Homo sapiens
KIADRFLLY

SEQ ID NO: 826 - protein, 15 aa, Homo sapiens
KIWRPDLVLYNNADG

SEQ ID NO: 827 - protein, 10 aa, Homo sapiens
KPRDVSSVEL

SEQ ID NO: 828 - protein, 11 aa, Homo sapiens
KPTISVKEAFY

SEQ ID NO: 829 - protein, 17 aa, Homo sapiens
KSAIEGIKYIAETMKSD

SEQ ID NO: 830 - protein, 9 aa, Homo sapiens
KTYGEIFEK

SEQ ID NO: 831 - protein, 14 aa, Homo sapiens
KVKKIYLDEKRLLA

SEQ ID NO: 832 - protein, 15 aa, Homo sapiens
KVKKIYLDEKRLLAG

SEQ ID NO: 833 - protein, 16 aa, Homo sapiens
KVKKIYLDEKRLLAGD

SEQ ID NO: 834 - protein, 13 aa, Homo sapiens
KVVPEMTEILKKK

SEQ ID NO: 835 - protein, 11 aa, Homo sapiens
KVYNEAGVTFT

SEQ ID NO: 836 - protein, 12 aa, Homo sapiens
KYLPGPLQDMFK

SEQ ID NO: 837 - protein, 11 aa, Homo sapiens
LASGVHGLPLL

SEQ ID NO: 838 - protein, 12 aa, Homo sapiens
LASVSTVLTSKY

SEQ ID NO: 839 - protein, 13 aa, Homo sapiens
LDFLKAVDTNRAS

SEQ ID NO: 840 - protein, 11 aa, Homo sapiens
LDTHPLPLVEV

SEQ ID NO: 841 - protein, 15 aa, Homo sapiens
LERIQIQEAAKKKPG

SEQ ID NO: 842 - protein, 9 aa, Homo sapiens
LFALTLPIW

SEQ ID NO: 843 - protein, 11 aa, Homo sapiens
LGSVAGIFNYY

SEQ ID NO: 844 - protein, 10 aa, Homo sapiens
LGVLESDLPS

SEQ ID NO: 845 - protein, 12 aa, Homo sapiens
LILPEAVGGTVF

SEQ ID NO: 846 - protein, 10 aa, Homo sapiens
LLPPPPPVAR

SEQ ID NO: 847 - protein, 13 aa, Homo sapiens
LLVIVELIPSTSS

SEQ ID NO: 848 - protein, 14 aa, Homo sapiens
LLVPTKARFPAFEL

SEQ ID NO: 849 - protein, 13 aa, Homo sapiens
LNETGDEPFQYKN

SEQ ID NO: 850 - protein, 14 aa, Homo sapiens
LNTILPDARDPAFK

SEQ ID NO: 851 - protein, 11 aa, Homo sapiens
LRPIQALGTEY

SEQ ID NO: 852 - protein, 14 aa, Homo sapiens
LSALEEYTKKLNTQ

SEQ ID NO: 853 - protein, 13 aa, Homo sapiens
LSFPTTKTYFPHF

SEQ ID NO: 854 - protein, 9 aa, Homo sapiens
LTDRELEEY

SEQ ID NO: 855 - protein, 9 aa, Homo sapiens
LVEAKQYII

SEQ ID NO: 856 - protein, 10 aa, Homo sapiens
LVSASQDGKL

SEQ ID NO: 857 - protein, 10 aa, Homo sapiens
LVVYFFRVRN

SEQ ID NO: 858 - protein, 10 aa, Homo sapiens
MLSNPDLMRQ

SEQ ID NO: 859 - protein, 9 aa, Homo sapiens
MPILGLGTW

SEQ ID NO: 860 - protein, 15 aa, Homo sapiens
MSILGMTPGFGDKTF

SEQ ID NO: 861 - protein, 10 aa, Homo sapiens
MSLKQTPLSR

SEQ ID NO: 862 - protein, 10 aa, Homo sapiens
NEIEDTFRQF

SEQ ID NO: 863 - protein, 12 aa, Homo sapiens
NETGDEPFQYKN

SEQ ID NO: 864 - protein, 15 aa, Homo sapiens
NQELRADGTVNQIEG

SEQ ID NO: 865 - protein, 10 aa, Homo sapiens
NRITIPVQTF

SEQ ID NO: 866 - protein, 8 aa, Homo sapiens
NTDSPLRY

SEQ ID NO: 867 - protein, 9 aa, Homo sapiens
NTEEEGLKY

SEQ ID NO: 868 - protein, 18 aa, Homo sapiens
NWVRKVFIDTIPNIMFFS

SEQ ID NO: 869 - protein, 11 aa, Homo sapiens
PEVLNRALSNL

SEQ ID NO: 870 - protein, 11 aa, Homo sapiens
PKFEVIEKPQA

SEQ ID NO: 871 - protein, 15 aa, Homo sapiens
PQRFVVIQNEDLGPA

SEQ ID NO: 872 - protein, 11 aa, Homo sapiens
PSIHIWDTETI

SEQ ID NO: 873 - protein, 13 aa, Homo sapiens
PVDLSKWSGPLSL

SEQ ID NO: 874 - protein, 14 aa, Homo sapiens
QEELPSLWNSRVGF

SEQ ID NO: 875 - protein, 11 aa, Homo sapiens
QIRETSLDTKS

SEQ ID NO: 876 - protein, 9 aa, Homo sapiens
QLYMIQKKS

SEQ ID NO: 877 - protein, 9 aa, Homo sapiens
QLYWSHPRK

SEQ ID NO: 878 - protein, 11 aa, Homo sapiens
QSMDSKLSGRY

SEQ ID NO: 879 - protein, 19 aa, Homo sapiens
QTPQHPSFLFQDKRVSWSL

SEQ ID NO: 880 - protein, 10 aa, Homo sapiens
QVADVVVSRW

SEQ ID NO: 881 - protein, 10 aa, Homo sapiens
QVLGVVARAA

SEQ ID NO: 882 - protein, 9 aa, Homo sapiens
RAIEQLAMM

SEQ ID NO: 883 - protein, 10 aa, Homo sapiens
RHGSKYLATA

SEQ ID NO: 884 - protein, 18 aa, Homo sapiens
RHGSKYLATASTMDHARH

SEQ ID NO: 885 - protein, 10 aa, Homo sapiens
RLYPWGVVEV

SEQ ID NO: 886 - protein, 10 aa, Homo sapiens
RQQPPDLVEF

SEQ ID NO: 887 - protein, 11 aa, Homo sapiens
SCGDLHSVMLE

SEQ ID NO: 888 - protein, 15 aa, Homo sapiens
SEHETRLVAKLFKDY

SEQ ID NO: 889 - protein, 11 aa, Homo sapiens
SGCDLEEIPLD

SEQ ID NO: 890 - protein, 14 aa, Homo sapiens
SHGRTQDENPVVHF

SEQ ID NO: 891 - protein, 10 aa, Homo sapiens
SHPPVEGSYA

SEQ ID NO: 892 - protein, 9 aa, Homo sapiens
SIFKQPVTK

SEQ ID NO: 893 - protein, 9 aa, Homo sapiens
SITSVFITK

SEQ ID NO: 894 - protein, 14 aa, Homo sapiens
SNAIINDGKYHVVR

SEQ ID NO: 895 - protein, 12 aa, Homo sapiens
SSKFQVDNNNRL

SEQ ID NO: 896 - protein, 10 aa, Homo sapiens
STDPSVLGKY

SEQ ID NO: 897 - protein, 9 aa, Homo sapiens
STIEYVIQR

SEQ ID NO: 898 - protein, 11 aa, Homo sapiens
STIGPEGVHQK

SEQ ID NO: 899 - protein, 12 aa, Homo sapiens
SVAALSCLMLVA

SEQ ID NO: 900 - protein, 10 aa, Homo sapiens
SVFQQGMKNK

SEQ ID NO: 901 - protein, 11 aa, Homo sapiens
SVPEFPLSPPK

SEQ ID NO: 902 - protein, 9 aa, Homo sapiens
SVSPVVHVR

SEQ ID NO: 903 - protein, 8 aa, Homo sapiens
TAIRHHVL

SEQ ID NO: 904 - protein, 10 aa, Homo sapiens
TGILDSIGRF

SEQ ID NO: 905 - protein, 11 aa, Homo sapiens
TIIDLPGITRV

SEQ ID NO: 906 - protein, 10 aa, Homo sapiens
TIQKSSLDQL

SEQ ID NO: 907 - protein, 9 aa, Homo sapiens
TLLGDFIYW

SEQ ID NO: 908 - protein, 10 aa, Homo sapiens
TMDHARHGFL

SEQ ID NO: 909 - protein, 16 aa, Homo sapiens
TNVPRASVPDGFLSEL

SEQ ID NO: 910 - protein, 14 aa, Homo sapiens
TPDAMKAAMALEKK

SEQ ID NO: 911 - protein, 16 aa, Homo sapiens
TSPAKQQAPPVRNLHQ

SEQ ID NO: 912 - protein, 10 aa, Homo sapiens
TTGILSILFY

SEQ ID NO: 913 - protein, 15 aa, Homo sapiens
TTMEKAGAHLQGGAK

SEQ ID NO: 914 - protein, 9 aa, Homo sapiens
TTYNYAVLK

SEQ ID NO: 915 - protein, 8 aa, Homo sapiens
TVFSTHFM

SEQ ID NO: 916 - protein, 12 aa, Homo sapiens
VDLEPTVIDEVR

SEQ ID NO: 917 - protein, 13 aa, Homo sapiens
VDPENFRLLGNVL

SEQ ID NO: 918 - protein, 12 aa, Homo sapiens
VDWIILQCAEDI

SEQ ID NO: 919 - protein, 12 aa, Homo sapiens
VEESKDAGIRTL

SEQ ID NO: 920 - protein, 10 aa, Homo sapiens
VGGEALGRLL

SEQ ID NO: 921 - protein, 13 aa, Homo sapiens
VHLKNASRGSAGN

SEQ ID NO: 922 - protein, 12 aa, Homo sapiens
VHLTPEEKSAVT

SEQ ID NO: 923 - protein, 31 aa, Homo sapiens
VHLTPEEKSAVTALWGKVNVDEVGGEALGRL

SEQ ID NO: 924 - protein, 10 aa, Homo sapiens
VIRLLLASGA

SEQ ID NO: 925 - protein, 9 aa, Homo sapiens
VLGDLFVRD

SEQ ID NO: 926 - protein, 11 aa, Homo sapiens
VLSPADKTNVK

SEQ ID NO: 927 - protein, 25 aa, Homo sapiens
VLSPADKTNVKAAWGKVGAHAGEYG

SEQ ID NO: 928 - protein, 31 aa, Homo sapiens
VLSPADKTNVKAAWGKVGAHAGEYGAEALER

SEQ ID NO: 929 - protein, 7 aa, Homo sapiens
VQMMTAK

SEQ ID NO: 930 - protein, 15 aa, Homo sapiens
VSHFFRELAEEKREG

SEQ ID NO: 931 - protein, 10 aa, Homo sapiens
VTASKAIIEK

SEQ ID NO: 932 - protein, 9 aa, Homo sapiens
VTMTASRML

SEQ ID NO: 933 - protein, 9 aa, Homo sapiens
VTNPDTGRY

SEQ ID NO: 934 - protein, 16 aa, Homo sapiens
VTPRTPPPSQGKGRGL

SEQ ID NO: 935 - protein, 9 aa, Homo sapiens
VTSPIRASY

SEQ ID NO: 936 - protein, 12 aa, Homo sapiens
VTVFPIGIGDRY

SEQ ID NO: 937 - protein, 14 aa, Homo sapiens
VVAGVANALAHKYH

SEQ ID NO: 938 - protein, 11 aa, Homo sapiens
VVIRGNSIIML

SEQ ID NO: 939 - protein, 11 aa, Homo sapiens
VVYPSSSQESE

SEQ ID NO: 940 - protein, 8 aa, Homo sapiens
VYRVNSYW

SEQ ID NO: 941 - protein, 17 aa, Homo sapiens
WISKQEYDESGPSIVHR

SEQ ID NO: 942 - protein, 18 aa, Homo sapiens
WISKQEYDESGPSIVHRK

SEQ ID NO: 943 - protein, 20 aa, Homo sapiens
WISKQEYDESGPSIVHRKCF

SEQ ID NO: 944 - protein, 10 aa, Homo sapiens
WSTVLSTYHF

SEQ ID NO: 945 - protein, 11 aa, Homo sapiens
WTTGTISSQRF

SEQ ID NO: 946 - protein, 13 aa, Homo sapiens
WVPYINGKFKKDN

SEQ ID NO: 947 - protein, 15 aa, Homo sapiens
WVSQRTATAGTASPP

SEQ ID NO: 948 - protein, 11 aa, Homo sapiens
YAVAVVKKDSG

SEQ ID NO: 949 - protein, 11 aa, Homo sapiens
YDESGPSIVHR

SEQ ID NO: 950 - protein, 12 aa, Homo sapiens
YDESGPSIVHRK

SEQ ID NO: 951 - protein, 14 aa, Homo sapiens
YDNEFGYSNRVVDL

SEQ ID NO: 952 - protein, 11 aa, Homo sapiens
YEMPSEEGYQD

SEQ ID NO: 953 - protein, 8 aa, Homo sapiens
YEVSQLKD

SEQ ID NO: 954 - protein, 8 aa, Homo sapiens
YGMPRQIL

SEQ ID NO: 955 - protein, 9 aa, Homo sapiens
YIDEQFERY

SEQ ID NO: 956 - protein, 10 aa, Homo sapiens
YIKEDEALPS

SEQ ID NO: 957 - protein, 9 aa, Homo sapiens
YLLLLLLLS

SEQ ID NO: 958 - protein, 13 aa, Homo sapiens
YQKVVAGVANALA

SEQ ID NO: 959 - protein, 17 aa, Homo sapiens
YQKVVAGVANALAHKYH

SEQ ID NO: 960 - protein, 10 aa, Homo sapiens
YTDVPFHNQY

SEQ ID NO: 961 - protein, 11 aa, Homo sapiens
YTERDASGMLY

SEQ ID NO: 962 - protein, 9 aa, Homo sapiens
APAHAITLT

SEQ ID NO: 963 - protein, 9 aa, Multiple sclerosis associated retrovirus
ATLKPATFL

SEQ ID NO: 964 - protein, 9 aa, Human endogenous retrovirus W
ATLNPATFL

SEQ ID NO: 965 - protein, 9 aa, Homo sapiens
CPRQRSSRA

SEQ ID NO: 966 - protein, 9 aa, Multiple sclerosis associated retrovirus
DPLNPTSQL

SEQ ID NO: 967 - protein, 9 aa, Multiple sclerosis associated retrovirus
FPYQRKYPL

SEQ ID NO: 968 - protein, 9 aa, Homo sapiens
GPARVPVPF

SEQ ID NO: 969 - protein, 9 aa, Multiple sclerosis associated retrovirus
GPCFLWLKL

SEQ ID NO: 970 - protein, 9 aa, Multiple sclerosis associated retrovirus
IPEEAEWFT

SEQ ID NO: 971 - protein, 9 aa, Multiple sclerosis associated retrovirus
IPFLGIRET

SEQ ID NO: 972 - protein, 9 aa, Homo sapiens
IPPKAKTPL

SEQ ID NO: 973 - protein, 9 aa, Homo sapiens
IPRLCPLQA

SEQ ID NO: 974 - protein, 12 aa, Multiple sclerosis associated retrovirus
IPVRPDSQFLFA

SEQ ID NO: 975 - protein, 12 aa, Homo sapiens
KEENPTAFLDRL

SEQ ID NO: 976 - protein, 9 aa, Multiple sclerosis associated retrovirus
KPNGQWRLV

SEQ ID NO: 977 - protein, 9 aa, Multiple sclerosis associated retrovirus
KPPPCPCPL

SEQ ID NO: 978 - protein, 9 aa, Multiple sclerosis associated retrovirus
KVSKPKARL

SEQ ID NO: 979 - protein, 9 aa, Multiple sclerosis associated retrovirus
LPLGSEQNL

SEQ ID NO: 980 - protein, 9 aa, Multiple sclerosis associated retrovirus
LPTGQDFSL

SEQ ID NO: 981 - protein, 14 aa, Multiple sclerosis associated retrovirus
MPESPTPLLGRDIL

SEQ ID NO: 982 - protein, 11 aa, Multiple sclerosis associated retrovirus
MPSPSEPRVCL

SEQ ID NO: 983 - protein, 9 aa, Homo sapiens
NPDGYIDVL

SEQ ID NO: 984 - protein, 12 aa, Human endogenous retrovirus W
NPHTPGTSTQLA

SEQ ID NO: 985 - protein, 9 aa, Multiple sclerosis associated retrovirus
NPRSENTRL

SEQ ID NO: 986 - protein, 15 aa, Multiple sclerosis associated retrovirus
PPPYPSVPSPTPSST

SEQ ID NO: 987 - protein, 9 aa, Homo sapiens
QPLSCDWGT

SEQ ID NO: 988 - protein, 9 aa, Multiple sclerosis associated retrovirus
RPAADFHPF

SEQ ID NO: 989 - protein, 11 aa, Multiple sclerosis associated retrovirus
RPLPLPIGLKA

SEQ ID NO: 990 - protein, 9 aa, Homo sapiens
SPDSIEGQL

SEQ ID NO: 991 - protein, 9 aa, Multiple sclerosis associated retrovirus
SPHLFGQAL

SEQ ID NO: 992 - protein, 9 aa, Multiple sclerosis associated retrovirus
TPIARPLYT

SEQ ID NO: 993 - protein, 9 aa, Homo sapiens
TPNERSAAV

SEQ ID NO: 994 - protein, 9 aa, Homo sapiens
VPCLRKELI

SEQ ID NO: 995 - protein, 9 aa, Multiple sclerosis associated retrovirus
VPPEAKMPL

SEQ ID NO: 996 - protein, 9 aa, Multiple sclerosis associated retrovirus
WPHCLWVMA

SEQ ID NO: 997 - protein, 11 aa, Multiple sclerosis associated retrovirus
YPAVSSPYTLL

SEQ ID NO: 998 - protein, 21 aa, Human T-lymphotropic virus
PPPPSSPTHDPPDSDPQIPPP

SEQ ID NO: 999 - protein, 21 aa, Homo sapiens
PTRAPSGPRPPSRSQAQTPPR

SEQ ID NO: 1000 - protein, 12 aa, Homo sapiens
ALTIYEMLQNIF

SEQ ID NO: 1001 - protein, 12 aa, Homo sapiens
CAWTIVRVEILR

SEQ ID NO: 1002 - protein, 12 aa, Homo sapiens
CLKDRMNFDIPE

SEQ ID NO: 1003 - protein, 15 aa, Helicobacter pylori
EEFIFHFIKNTRDGL

SEQ ID NO: 1004 - protein, 12 aa, Homo sapiens
EMLQNIFAIFRQ

SEQ ID NO: 1005 - protein, 12 aa, Homo sapiens
ETIVENLLANVY

SEQ ID NO: 1006 - protein, 12 aa, Homo sapiens
FTRGKLMSSLHL

SEQ ID NO: 1007 - protein, 12 aa, Homo sapiens
GRLEYCLKDRMN

SEQ ID NO: 1008 - protein, 12 aa, Homo sapiens
HLKRYYGRILHY

SEQ ID NO: 1009 - protein, 12 aa, Homo sapiens
HYLKAKEYSHCA

SEQ ID NO: 1010 - protein, 12 aa, Homo sapiens
KEYSHCAWTIVR

SEQ ID NO: 1011 - protein, 12 aa, Homo sapiens
LEKEDFTRGKLM

SEQ ID NO: 1012 - protein, 12 aa, Homo sapiens
LGFLQRSSNFQC

SEQ ID NO: 1013 - protein, 12 aa, Homo sapiens
LMSSLHLKRYYG

SEQ ID NO: 1014 - protein, 12 aa, Homo sapiens
LRNFYFINRLTG

SEQ ID NO: 1015 - protein, 12 aa, Homo sapiens
LWQLNGRLEYCL

SEQ ID NO: 1016 - protein, 12 aa, Homo sapiens
MNFDIPEEIKQL

SEQ ID NO: 1017 - protein, 12 aa, Homo sapiens
MSYNLLGFLQRS

SEQ ID NO: 1018 - protein, 12 aa, Homo sapiens
NHLKTVLEEKLE

SEQ ID NO: 1019 - protein, 12 aa, Homo sapiens
NLLANVYHQINH

SEQ ID NO: 1020 - protein, 12 aa, Homo sapiens
PEEIKQLQQFQK

SEQ ID NO: 1021 - protein, 12 aa, Homo sapiens
QCQKLLWQLNGR

SEQ ID NO: 1022 - protein, 12 aa, Homo sapiens
QKEDAALTIYEM

SEQ ID NO: 1023 - protein, 12 aa, Homo sapiens
QLQQFQKEDAAL

SEQ ID NO: 1024 - protein, 12 aa, Homo sapiens
RQDSSSTGWNET

SEQ ID NO: 1025 - protein, 12 aa, Homo sapiens
RSSNFQCQKLLW

SEQ ID NO: 1026 - protein, 12 aa, Homo sapiens
STGWNETIVENL

SEQ ID NO: 1027 - protein, 12 aa, Homo sapiens
VLEEKLEKEDFT

SEQ ID NO: 1028 - protein, 12 aa, Homo sapiens
VRVEILRNFYFI

SEQ ID NO: 1029 - protein, 12 aa, Homo sapiens
VYHQINHLKTVL

SEQ ID NO: 1030 - protein, 12 aa, Homo sapiens
YFINRLTGYLRN

SEQ ID NO: 1031 - protein, 12 aa, Homo sapiens
YGRILHYLKAKE

SEQ ID NO: 1032 - protein, 3 aa, Unknown
  epitope involved in multiple sclerosis
FFK

SEQ ID NO: 1033 - protein, 10 aa, Unknown
  epitope involved in multiple sclerosis
LIMFKNVVIK

SEQ ID NO: 1034 - protein, 11 aa, Unknown
  epitope involved in multiple sclerosis
VIIFFKNVVIK

SEQ ID NO: 1035 - protein, 11 aa, Homo sapiens
VVHFFKNIVTP

SEQ ID NO: 1036 - protein, 11 aa, Unknown
  epitope involved in multiple sclerosis
VVHFFKNVVIK

SEQ ID NO: 1037 - protein, 11 aa, Unknown
  epitope involved in multiple sclerosis
VVHFFKNVVIP

SEQ ID NO: 1038 - protein, 11 aa, Unknown
  epitope involved in multiple sclerosis
VVHFFKNVVTP

SEQ ID NO: 1039 - protein, 3 aa, Unknown
  epitope involved in multiple sclerosis
VVI

SEQ ID NO: 1040 - protein, 11 aa, Unknown
  epitope involved in multiple sclerosis
VVIFFKNVVIK

SEQ ID NO: 1041 - protein, 7 aa, Unknown
  epitope involved in multiple sclerosis
ERPNHTV

SEQ ID NO: 1042 - protein, 5 aa, Unknown
  epitope involved in multiple sclerosis
RPNHT

SEQ ID NO: 1043 - protein, 21 aa, Unknown
  epitope involved in multiple sclerosis
TPRVERGNHTVFLAPYGWMVK

SEQ ID NO: 1044 - protein, 21 aa, Unknown
  epitope involved in multiple sclerosis
TPRVERNGHSVFLAPYGWMVK

SEQ ID NO: 1045 - protein, 21 aa, Unknown
  epitope involved in multiple sclerosis
TPRVERPNHTVFLAPYGWMVK

SEQ ID NO: 1046 - protein, 19 aa, Homo sapiens
ADDLKKLKPGLEKDFLPLY

SEQ ID NO: 1047 - protein, 19 aa, Homo sapiens
AVQTGLDLLEILRQEKGGS

SEQ ID NO: 1048 - protein, 19 aa, Homo sapiens
DNLPRGSRAHITLGCAADV

SEQ ID NO: 1049 - protein, 21 aa, Homo sapiens
DQYQYQVVLVEPKTAWRLDCA

SEQ ID NO: 1050 - protein, 18 aa, Homo sapiens
DTVATLLECKTLFILRGL

SEQ ID NO: 1051 - protein, 34 aa, Homo sapiens
DVLKKSYSKAFTLTISALFVTPKTTGARVELSEQ

SEQ ID NO: 1052 - protein, 19 aa, Homo sapiens
EELGNHKAFKKELRQFVPG

SEQ ID NO: 1053 - protein, 18 aa, Homo sapiens
ELQFPFLQDEDTVATLLE

SEQ ID NO: 1054 - protein, 18 aa, Homo sapiens
ELSEQQLQLWPSDVDKLS

SEQ ID NO: 1055 - protein, 19 aa, Homo sapiens
EPREKMDLVTYFGKRPPGV

SEQ ID NO: 1056 - protein, 39 aa, Homo sapiens
FPFLQDEDTVATLLECKTLFILRGLPGSGKSTLARVIVD

SEQ ID NO: 1057 - protein, 19 aa, Homo sapiens
GARGAFSEEYKRLDEDLAA

SEQ ID NO: 1058 - protein, 19 aa, Homo sapiens
GEEVGELSRGKLYSLGNGR

SEQ ID NO: 1059 - protein, 21 aa, Homo sapiens
GKPVPTQGSRKGGALQSCTII

SEQ ID NO: 1060 - protein, 19 aa, Homo sapiens
GWFLTKKSSETLRKAGQVF

SEQ ID NO: 1061 - protein, 19 aa, Homo sapiens
HCTTKFCDYGKAPGAEEYA

SEQ ID NO: 1062 - protein, 19 aa, Homo sapiens
ILRQEKGGSRGEEVGELSR

SEQ ID NO: 1063 - protein, 19 aa, Homo sapiens
ITLGCAADVEAVQTGLDLL

SEQ ID NO: 1064 - protein, 20 aa, Homo sapiens
KAFTLTISALFVTPKTTGAR

SEQ ID NO: 1065 - protein, 19 aa, Homo sapiens
KAPGAEEYAQQDVLKKSYS

SEQ ID NO: 1066 - protein, 19 aa, Mus musculus
KEKRQFVPGDEPREKMDLV

SEQ ID NO: 1067 - protein, 32 aa, Homo sapiens
KKLKPGLEKDFLPLYFGWFLTKKSSETLRKAG

SEQ ID NO: 1068 - protein, 19 aa, Homo sapiens
KLYSLGNGRWMLTLAKNME

SEQ ID NO: 1069 - protein, 19 aa, Homo sapiens
KRLDEDLAAYCRRRDIRIL

SEQ ID NO: 1070 - protein, 19 aa, Homo sapiens
KTAWRLDCAQLKEKNQWQL

SEQ ID NO: 1071 - protein, 19 aa, Homo sapiens
LDDTNHERERLEQLFEMAD

SEQ ID NO: 1072 - protein, 19 aa, Homo sapiens
LEKDFLPLYFGWFLTKKSS

SEQ ID NO: 1073 - protein, 18 aa, Mus musculus
LEQLFEMADQYQQVVLVE

SEQ ID NO: 1074 - protein, 18 aa, Homo sapiens
LKEKNQWQLSADDLKKLK

SEQ ID NO: 1075 - protein, 19 aa, Homo sapiens
MLTLAKNMEVRAIFTGYYG

SEQ ID NO: 1076 - protein, 19 aa, Homo sapiens
MSSSGAKDKPELQFPFLQD

SEQ ID NO: 1077 - protein, 19 aa, Homo sapiens
PSDVDKLSPTDNLPRGSRA

SEQ ID NO: 1078 - protein, 19 aa, Homo sapiens
QDVLKKSYSKAFTLTISAL

SEQ ID NO: 1079 - protein, 19 aa, Homo sapiens
RAIFTGYYGKGKPVPTQGS

SEQ ID NO: 1080 - protein, 18 aa, Homo sapiens
RRRDIRILVLDDTNHERE

SEQ ID NO: 1081 - protein, 19 aa, Homo sapiens
SGKSTLARVIVDKYRDGTK

SEQ ID NO: 1082 - protein, 19 aa, Homo sapiens
TLFILRGLPGSGKSTLARV

SEQ ID NO: 1083 - protein, 19 aa, Homo sapiens
TLRKAGQVFLEELGNHKAF

SEQ ID NO: 1084 - protein, 19 aa, Homo sapiens
VDKYRDGTKMVSADAYKIT

SEQ ID NO: 1085 - protein, 19 aa, Homo sapiens
VSADAYKITPGARGAFSEE

SEQ ID NO: 1086 - protein, 19 aa, Homo sapiens
VTPKTTGARVELSEQQLQL

SEQ ID NO: 1087 - protein, 19 aa, Homo sapiens
YFGKRPPGVLHCTTKFCDY

SEQ ID NO: 1088 - protein, 16 aa, Homo sapiens
AAMELKVEDPFYWVSP

SEQ ID NO: 1089 - protein, 9 aa, Homo sapiens
CLQYRLRGK

SEQ ID NO: 1090 - protein, 16 aa, Homo sapiens
CWKITLFVIVPVLGPL

SEQ ID NO: 1091 - protein, 16 aa, Homo sapiens
DPFYWVSPGVLVLLAV

SEQ ID NO: 1092 - protein, 16 aa, Homo sapiens
DPHFLRVPCWKITLFV

SEQ ID NO: 1093 - protein, 16 aa, Homo sapiens
EGGFTCFFRDHSYQEE

SEQ ID NO: 1094 - protein, 16 aa, Homo sapiens
ELPCRISPGKNATGME

SEQ ID NO: 1095 - protein, 17 aa, Homo sapiens
ENPVVHFFKNIVTPRTP

SEQ ID NO: 1096 - protein, 9 aa, Homo sapiens
FLCLQYRLR

SEQ ID NO: 1097 - protein, 16 aa, Homo sapiens
GDEVELPCRISPGKNA

SEQ ID NO: 1098 - protein, 16 aa, Homo sapiens
GEGKVTLRIRNVRFSD

SEQ ID NO: 1099 - protein, 16 aa, Homo sapiens
GKNATGMEVGWYRPPF

SEQ ID NO: 1100 - protein, 9 aa, Homo sapiens
GLVFLCLQY

SEQ ID NO: 1101 - protein, 16 aa, Homo sapiens
GQFRVIGPRHPIRALV

SEQ ID NO: 1102 - protein, 16 aa, Homo sapiens
GVLVLLAVLPVLLLQI

SEQ ID NO: 1103 - protein, 16 aa, Homo sapiens
HLYRNGKDQDGDQAPE

SEQ ID NO: 1104 - protein, 16 aa, Homo sapiens
HRTFDPHFLRVPCWKI

SEQ ID NO: 1105 - protein, 16 aa, Homo sapiens
ICYNWLHRRLAGQFLE

SEQ ID NO: 1106 - protein, 16 aa, Homo sapiens
IENLHRTFDPHFLRVP

SEQ ID NO: 1107 - protein, 16 aa, Homo sapiens
IRNVRFSDEGGFTCFF

SEQ ID NO: 1108 - protein, 16 aa, Homo sapiens
IVPVLGPLVALIICYN

SEQ ID NO: 1109 - protein, 16 aa, Homo sapiens
KDAIGEGKVTLRIRNV

SEQ ID NO: 1110 - protein, 21 aa, Homo sapiens
KNATGMEVGWYRPPFSRVVHL

SEQ ID NO: 1111 - protein, 21 aa, Homo sapiens
KNATGMEVGWYRPPFSRVVHL

SEQ ID NO: 1112 - protein, 9 aa, Homo sapiens
LCLQYRLRG

SEQ ID NO: 1113 - protein, 16 aa, Homo sapiens
LGPLVALIICYNWLHR

SEQ ID NO: 1114 - protein, 16 aa, Homo sapiens
LKVEDPFYWVSPGVLV

SEQ ID NO: 1115 - protein, 16 aa, Homo sapiens
LLAVLPVLLLQITVGL

SEQ ID NO: 1116 - protein, 16 aa, Homo sapiens
LLQITVGLVFLCLQYR

SEQ ID NO: 1117 - protein, 16 aa, Homo sapiens
LPVLLLQITVGLVFLC

SEQ ID NO: 1118 - protein, 16 aa, Homo sapiens
LQYRLRGKLRAEIENL

SEQ ID NO: 1119 - protein, 16 aa, Homo sapiens
LRAEIENLHRTFDPHF

SEQ ID NO: 1120 - protein, 16 aa, Homo sapiens
LRGKLRAEIENLHRTF

SEQ ID NO: 1121 - protein, 16 aa, Homo sapiens
LRVPCWKITLFVIVPV

SEQ ID NO: 1122 - protein, 9 aa, Homo sapiens
LVFLCLQYR

SEQ ID NO: 1123 - protein, 16 aa, Homo sapiens
NGKDQDGDQAPEYRGR

SEQ ID NO: 1124 - protein, 16 aa, Homo sapiens
QAPEYRGRTELLKDAI

SEQ ID NO: 1125 - protein, 16 aa, Homo sapiens
QDGDQAPEYRGRTELL

SEQ ID NO: 1126 - protein, 9 aa, Homo sapiens
QYRLRGKLR

SEQ ID NO: 1127 - protein, 16 aa, Homo sapiens
RALVGDEVELPCRISP

SEQ ID NO: 1128 - protein, 16 aa, Homo sapiens
RDHSYQEEAAMELKVE

SEQ ID NO: 1129 - protein, 16 aa, Homo sapiens
RFSDEGGFTCFFRDHS

SEQ ID NO: 1130 - protein, 16 aa, Homo sapiens
RHPIRALVGDEVELPC

SEQ ID NO: 1131 - protein, 16 aa, Homo sapiens
RISPGKNATGMEVGWY

SEQ ID NO: 1132 - protein, 14 aa, Homo sapiens
RLAGQFLEELRNPF

SEQ ID NO: 1133 - protein, 9 aa, Homo sapiens
RLRGKLRAE

SEQ ID NO: 1134 - protein, 16 aa, Homo sapiens
RPPFSRVVHLYRNGKD

SEQ ID NO: 1135 - protein, 16 aa, Homo sapiens
SRVVHLYRNGKDQDGD

SEQ ID NO: 1136 - protein, 16 aa, Homo sapiens
TCFFRDHSYQEEAAME

SEQ ID NO: 1137 - protein, 16 aa, Homo sapiens
TELLKDAIGEGKVTLR

SEQ ID NO: 1138 - protein, 16 aa, Homo sapiens
TGMEVGWYRPPFSRVV

SEQ ID NO: 1139 - protein, 16 aa, Homo sapiens
TLFVIVPVLGPLVALI

SEQ ID NO: 1140 - protein, 21 aa, Unknown
  epitope involved in multiple sclerosis
TPRVERNGHSVFLAPYGWMVK

SEQ ID NO: 1141 - protein, 21 aa, Unknown
  epitope involved in multiple sclerosis
TPRVERNGHSVFLAPYGWMVK

SEQ ID NO: 1142 - protein, 16 aa, Homo sapiens
TVGLVFLCLQYRLRGK

SEQ ID NO: 1143 - protein, 16 aa, Homo sapiens
VALIICYNWLHRRLAG

SEQ ID NO: 1144 - protein, 9 aa, Homo sapiens
VFLCLQYRL

SEQ ID NO: 1145 - protein, 9 aa, Homo sapiens
VGLVFLCLQ

SEQ ID NO: 1146 - protein, 16 aa, Homo sapiens
VGWYRPPFSRVVHLYR

SEQ ID NO: 1147 - protein, 16 aa, Homo sapiens
VIGPRHPIRALVGDEV

SEQ ID NO: 1148 - protein, 16 aa, Homo sapiens
VTLRIRNVRFSDEGGF

SEQ ID NO: 1149 - protein, 16 aa, Homo sapiens
WLHRRLAGQFLEELRN

SEQ ID NO: 1150 - protein, 16 aa, Homo sapiens
WVSPGVLVLLAVLPVL

SEQ ID NO: 1151 - protein, 16 aa, Homo sapiens
YQEEAAMELKVEDPFY

SEQ ID NO: 1152 - protein, 16 aa, Homo sapiens
YRGRTELLKDAIGEGK

SEQ ID NO: 1153 - protein, 9 aa, Homo sapiens
YRLRGKLRA

SEQ ID NO: 1154 - protein, 21 aa, Human herpesvirus
AGAGGGAGGAGAGGGAGGAGG

SEQ ID NO: 1155 - protein, 28 aa, Human herpesvirus
DGEPDVPPGAIEQGPADDPGEGPSTGPR

SEQ ID NO: 1156 - protein, 22 aa, Human herpesvirus
GGSGGRRGRGRERARGGSRERA

SEQ ID NO: 1157 - protein, 26 aa, Human herpesvirus
GVFVYGGSKTSLYNLRRGTALAIPQC

SEQ ID NO: 1158 - protein, 26 aa, Human herpesvirus
KFENIAEGLRALLARSHVERTTDEGT

SEQ ID NO: 1159 - protein, 27 aa, Human herpesvirus
KKGGWFGKHRGQGGSNPKFENIAEGLR

SEQ ID NO: 1160 - protein, 44 aa, Human herpesvirus
MSDEGPGTGPGNGLGEKGDTSGPEGSGGSGPQRRGGDNHGRGRG

SEQ ID NO: 1161 - protein, 27 aa, Human herpesvirus
PPRRPPPGRRPFFHPVGEADYFEYHQE

SEQ ID NO: 1162 - protein, 28 aa, Human herpesvirus
PRGQGDGGRRKKGGWFGKHRGQGGSNPK

SEQ ID NO: 1163 - protein, 26 aa, Human herpesvirus
QGPADDPGEGPSTGPRGQGDGGRRKK

SEQ ID NO: 1164 - protein, 20 aa, Human herpesvirus
RERARGGSRERARGRGRGRG

SEQ ID NO: 1165 - protein, 149 aa, Human herpesvirus
RKKGGWFGKHRGQGGSNPKFENIAEGLRALLARSHVERTTDEGTWVAGVFVYGGSKTSLYNLRRGTALAIPQCRLTPLSRLPFGMAPGPGPQPGPLRESIVCYFMVFLQTHIFAEVLKDAIKDLVMTKPAPTCNIRVTVCSFDDGVDLP

SEQ ID NO: 1166 - protein, 28 aa, Human herpesvirus
VEGAAAEGDDGDDGDEGGDGDEGEEGQE

SEQ ID NO: 1167 - protein, 20 aa, Homo sapiens
AVIMGNWENHWIYWVGPIIG

SEQ ID NO: 1168 - protein, 20 aa, Homo sapiens
AVLAGGLYEYVFCPDVEFKR

SEQ ID NO: 1169 - protein, 20 aa, Homo sapiens
DLILKPGVVHVIDVDRGEEK

SEQ ID NO: 1170 - protein, 20 aa, Homo sapiens
EDNRSQVETDDLILKPGVVH

SEQ ID NO: 1171 - protein, 20 aa, Homo sapiens
GILYLVTPPSVVGGLGVTMV

SEQ ID NO: 1172 - protein, 20 aa, Homo sapiens
GKCGPLCTRENIMVAFKGVW

SEQ ID NO: 1173 - protein, 20 aa, Homo sapiens
GTEKPLPVDMVLISLCFGLS

SEQ ID NO: 1174 - protein, 20 aa, Homo sapiens
HGNLTAGHGLLVELIITFQL

SEQ ID NO: 1175 - protein, 20 aa, Homo sapiens
HLFAINYTGASMNPARSFGP

SEQ ID NO: 1176 - protein, 20 aa, Homo sapiens
IATMVQCFGHISGGHINPAV

SEQ ID NO: 1177 - protein, 20 aa, Homo sapiens
ISGGHINPAVTVAMVCTRKI

SEQ ID NO: 1178 - protein, 20 aa, Homo sapiens
KRTDVTGSIALAIGFSVAIG

SEQ ID NO: 1179 - protein, 20 aa, Homo sapiens
LSLGSTINWGGTEKPLPVDM

SEQ ID NO: 1180 - protein, 20 aa, Homo sapiens
MSDRPTARRWGKCGPLCTRE

SEQ ID NO: 1181 - protein, 20 aa, Homo sapiens
NIMVAFKGVWTQAFWKAVTA

SEQ ID NO: 1182 - protein, 20 aa, Homo sapiens
QQTKGSYMEVEDNRSQVETD

SEQ ID NO: 1183 - protein, 20 aa, Homo sapiens
RFKEAFSKAAQQTKGSYMEV

SEQ ID NO: 1184 - protein, 20 aa, Homo sapiens
SIAKSVFYIAAQCLGAIIGA

SEQ ID NO: 1185 - protein, 20 aa, Homo sapiens
SMNPARSFGPAVIMGNWENH

SEQ ID NO: 1186 - protein, 20 aa, Homo sapiens
TQAFWKAVTAEFLAMLIFVL

SEQ ID NO: 1187 - protein, 20 aa, Homo sapiens
TVAMVCTRKISIAKSVFYIA

SEQ ID NO: 1188 - protein, 20 aa, Homo sapiens
VFCPDVEFKRRFKEAFSKAA

SEQ ID NO: 1189 - protein, 20 aa, Homo sapiens
VFTIFASCDSKRTDVTGSIA

SEQ ID NO: 1190 - protein, 20 aa, Homo sapiens
VVGGLGVTMVHGNLTAGHGL

SEQ ID NO: 1191 - protein, 20 aa, Homo sapiens
WIYWVGPIIGAVLAGGLYEY

SEQ ID NO: 1192 - protein, 19 aa, Homo sapiens
NATGMEVGWYRPPFSRVVH

SEQ ID NO: 1193 - protein, 12 aa, Homo sapiens
RALVGDEVELPC

SEQ ID NO: 1194 - protein, 21 aa, Unknown
  epitope involved in multiple sclerosis
TPRVERFGHSVFLAPYGWMVK

SEQ ID NO: 1195 - protein, 21 aa, Unknown
  epitope involved in multiple sclerosis
TPRVERGGHSVFLAPYGWMVK

SEQ ID NO: 1196 - protein, 21 aa, Unknown
  epitope involved in multiple sclerosis
TPRVERQGHSVFLAPYGWMVK

SEQ ID NO: 1197 - protein, 15 aa, Homo sapiens
EKKGKDQSGEVLSSV

SEQ ID NO: 1198 - protein, 24 aa, Homo sapiens
FCPDVEFKRRFKEAFSKAAQQTKG

SEQ ID NO: 1199 - protein, 12 aa, Unknown
  epitope involved in multiple sclerosis
DPGQLRLWRLAS

SEQ ID NO: 1200 - protein, 12 aa, Unknown
  epitope involved in multiple sclerosis
FHQPTYDYTVSR

SEQ ID NO: 1201 - protein, 12 aa, Unknown
  epitope involved in multiple sclerosis
FSKTEPLSPSWF

SEQ ID NO: 1202 - protein, 12 aa, Unknown
  epitope involved in multiple sclerosis
GTWICDFKSCSW

SEQ ID NO: 1203 - protein, 12 aa, Unknown
  epitope involved in multiple sclerosis
HIDVSRPWRVTG

SEQ ID NO: 1204 - protein, 12 aa, Unknown
  epitope involved in multiple sclerosis
HWRHWLADTAFP

SEQ ID NO: 1205 - protein, 12 aa, Unknown
  epitope involved in multiple sclerosis
HYNPWEQEPMMY

SEQ ID NO: 1206 - protein, 12 aa, Unknown
  epitope involved in multiple sclerosis
NALTESKYVKLL

SEQ ID NO: 1207 - protein, 12 aa, Unknown
  epitope involved in multiple sclerosis
NCAFWLGKLYCR

SEQ ID NO: 1208 - protein, 12 aa, Homo sapiens
NCSWCHVLQRCS

SEQ ID NO: 1209 - protein, 10 aa, Prochlorococcus marinus
NCWKPQVLHC

SEQ ID NO: 1210 - protein, 12 aa, Unknown
  epitope involved in multiple sclerosis
NNLTQSKFLRLQ

SEQ ID NO: 1211 - protein, 12 aa, Unknown
  epitope involved in multiple sclerosis
NNPAPVYTHRVL

SEQ ID NO: 1212 - protein, 12 aa, Unknown
  epitope involved in multiple sclerosis
NPVEHWLAVLPT

SEQ ID NO: 1213 - protein, 12 aa, Unknown
  epitope involved in multiple sclerosis
NYPSWLHAYRLA

SEQ ID NO: 1214 - protein, 12 aa, Unknown
  epitope involved in multiple sclerosis
QHNVSRPWVLFT

SEQ ID NO: 1215 - protein, 12 aa, Unknown
  epitope involved in multiple sclerosis
SCNYHGRTLTCW

SEQ ID NO: 1216 - protein, 12 aa, Unknown
  epitope involved in multiple sclerosis
SCNYHHTYLTCW

SEQ ID NO: 1217 - protein, 12 aa, Unknown
  epitope involved in multiple sclerosis
SCQLVRTIWSCS

SEQ ID NO: 1218 - protein, 12 aa, Unknown
  epitope involved in multiple sclerosis
SLGSKMDISRPW

SEQ ID NO: 1219 - protein, 12 aa, Unknown
  epitope involved in multiple sclerosis
STLSESKVNRLL

SEQ ID NO: 1220 - protein, 12 aa, Unknown
  epitope involved in multiple sclerosis
TAQDISRPWWFP

SEQ ID NO: 1221 - protein, 12 aa, Unknown
  epitope involved in multiple sclerosis
TIMDISRTWTKV

SEQ ID NO: 1222 - protein, 12 aa, Unknown
  epitope involved in multiple sclerosis
TNTLTPHKLQML

SEQ ID NO: 1223 - protein, 12 aa, Unknown
  epitope involved in multiple sclerosis
TPQQDLYDIMYD

SEQ ID NO: 1224 - protein, 12 aa, Unknown
  epitope involved in multiple sclerosis
TQGLKYWYPVWS

SEQ ID NO: 1225 - protein, 12 aa, Unknown
  epitope involved in multiple sclerosis
VPQKYWWLSDHT

SEQ ID NO: 1226 - protein, 12 aa, Unknown
  epitope involved in multiple sclerosis
VVPKYWWSAELP

SEQ ID NO: 1227 - protein, 12 aa, Unknown
  epitope involved in multiple sclerosis
WHWRQPTWLQVI

SEQ ID NO: 1228 - protein, 11 aa, Homo sapiens
FFRDHSYQEEA

SEQ ID NO: 1229 - protein, 11 aa, Unknown
  epitope involved in multiple sclerosis
FFRDHSYQSEA

SEQ ID NO: 1230 - protein, 7 aa, Unknown
  epitope involved in multiple sclerosis
APAHHPP

SEQ ID NO: 1231 - protein, 7 aa, Unknown
  epitope involved in multiple sclerosis
APAHQIP

SEQ ID NO: 1232 - protein, 7 aa, Unknown
  epitope involved in multiple sclerosis
APPHLPP

SEQ ID NO: 1233 - protein, 7 aa, Unknown
  epitope involved in multiple sclerosis
APPHQMP

SEQ ID NO: 1234 - protein, 7 aa, Unknown
  epitope involved in multiple sclerosis
APPHVMP

SEQ ID NO: 1235 - protein, 7 aa, Unknown
  epitope involved in multiple sclerosis
APSHPPP

SEQ ID NO: 1236 - protein, 7 aa, Unknown
  epitope involved in multiple sclerosis
EFGTFLW

SEQ ID NO: 1237 - protein, 6 aa, Unknown
  epitope involved in multiple sclerosis
FGTYLW

SEQ ID NO: 1238 - protein, 7 aa, Unknown
  epitope involved in multiple sclerosis
FHLPWMQ

SEQ ID NO: 1239 - protein, 7 aa, Unknown
  epitope involved in multiple sclerosis
GPVNMNL

SEQ ID NO: 1240 - protein, 7 aa, Unknown
  epitope involved in multiple sclerosis
GRQAQYY

SEQ ID NO: 1241 - protein, 11 aa, Human herpesvirus
GRRPFFHPVGE

SEQ ID NO: 1242 - protein, 7 aa, Unknown
  epitope involved in multiple sclerosis
ILNWHQF

SEQ ID NO: 1243 - protein, 7 aa, Unknown
  epitope involved in multiple sclerosis
KFGTALW

SEQ ID NO: 1244 - protein, 7 aa, Unknown
  epitope involved in multiple sclerosis
KWPIIDT

SEQ ID NO: 1245 - protein, 6 aa, Unknown
  epitope involved in multiple sclerosis
LNWNPF

SEQ ID NO: 1246 - protein, 7 aa, Unknown
  epitope involved in multiple sclerosis
MFNWHPF

SEQ ID NO: 1247 - protein, 7 aa, Unknown
  epitope involved in multiple sclerosis
MQAHQTK

SEQ ID NO: 1248 - protein, 7 aa, Unknown
  epitope involved in multiple sclerosis
PLELSVY

SEQ ID NO: 1249 - protein, 7 aa, Unknown
  epitope involved in multiple sclerosis
PVELQLY

SEQ ID NO: 1250 - protein, 7 aa, Unknown
  epitope involved in multiple sclerosis
PVGPWTN

SEQ ID NO: 1251 - protein, 7 aa, Unknown
  epitope involved in multiple sclerosis
QFGTFLW

SEQ ID NO: 1252 - protein, 8 aa, Homo sapiens
SFDGTFLW

SEQ ID NO: 1253 - protein, 7 aa, Unknown
  epitope involved in multiple sclerosis
SFGTALW

SEQ ID NO: 1254 - protein, 7 aa, Unknown
  epitope involved in multiple sclerosis
SFGTFLW

SEQ ID NO: 1255 - protein, 7 aa, Unknown
  epitope involved in multiple sclerosis
SFGTILW

SEQ ID NO: 1256 - protein, 7 aa, Unknown
  epitope involved in multiple sclerosis
SHRPTTQ

SEQ ID NO: 1257 - protein, 7 aa, Unknown
  epitope involved in multiple sclerosis
SQSVAAS

SEQ ID NO: 1258 - protein, 7 aa, Unknown
  epitope involved in multiple sclerosis
STEGRHN

SEQ ID NO: 1259 - protein, 7 aa, Unknown
  epitope involved in multiple sclerosis
TVQPQFH

SEQ ID NO: 1260 - protein, 7 aa, Unknown
  epitope involved in multiple sclerosis
TYMVPAP

SEQ ID NO: 1261 - protein, 8 aa, Unknown
  epitope involved in multiple sclerosis
VLNRWNPF

SEQ ID NO: 1262 - protein, 7 aa, Unknown
  epitope involved in multiple sclerosis
VLNWHPF

SEQ ID NO: 1263 - protein, 7 aa, Unknown
  epitope involved in multiple sclerosis
WGLDNPP

SEQ ID NO: 1264 - protein, 7 aa, Unknown
  epitope involved in multiple sclerosis
WYYKPPA

SEQ ID NO: 1265 - protein, 9 aa, Human herpesvirus
RPRTPPPSY

SEQ ID NO: 1266 - protein, 8 aa, Homo sapiens
TPRTPPPQ

SEQ ID NO: 1267 - protein, 13 aa, Homo sapiens
FSWGAEGQRPGFG

SEQ ID NO: 1268 - protein, 25 aa, Homo sapiens
SIAFPSKTSASIGSLCADARMYGVL

SEQ ID NO: 1269 - protein, 17 aa, Homo sapiens
SLCFGLSIATMVQCFGH

SEQ ID NO: 1270 - protein, 18 aa, Homo sapiens
VIDVDRGEEKKGKDQSGE

SEQ ID NO: 1271 - protein, 11 aa, Homo sapiens
GDEVELPCRIS

SEQ ID NO: 1272 - protein, 14 aa, Homo sapiens
LTVGLTRRGQPRQY

SEQ ID NO: 1273 - protein, 14 aa, Homo sapiens
LTVGLTRRGQPRQY

SEQ ID NO: 1274 - protein, 13 aa, Homo sapiens
YNQYSQRYHQRTN

SEQ ID NO: 1275 - protein, 13 aa, Homo sapiens
YNQYSQRYHQRTN

SEQ ID NO: 1276 - protein, 21 aa, Homo sapiens
GITVSRNGSSVFTTSQDSTLK

SEQ ID NO: 1277 - protein, 21 aa, Unknown
  epitope involved in multiple sclerosis
TCFFRDGNYQEEAAMELKVED

SEQ ID NO: 1278 - protein, 19 aa, Homo sapiens
TFRDLGNLTHLFLHGNRIS

SEQ ID NO: 1279 - protein, 21 aa, Unknown
  epitope involved in multiple sclerosis
TFRVLRNGTSVFLHPNKWTVK

SEQ ID NO: 1280 - protein, 19 aa, Homo sapiens
TLINLTNLTHLYLHNNKFT

SEQ ID NO: 1281 - protein, 21 aa, Homo sapiens
VVHLYRNGKDQDGDQAPEYRG

SEQ ID NO: 1282 - protein, 11 aa, Homo sapiens
ERLGPLVEQGR

SEQ ID NO: 1283 - protein, 15 aa, Homo sapiens
KLTSEARGRIPVAQK

SEQ ID NO: 1284 - protein, 27 aa, Homo sapiens
MKILTERGYSFTTTAEREIVRDIKEKL

SEQ ID NO: 1285 - protein, 15 aa, Homo sapiens
AHYGSLPQKSHGRTQ

SEQ ID NO: 1286 - protein, 15 aa, Homo sapiens
DPVVHFFKNIVTPRT

SEQ ID NO: 1287 - protein, 16 aa, Homo sapiens
GKGRGLSLSRFSWGAE

SEQ ID NO: 1288 - protein, 7 aa, Homo sapiens
GLQLYFS

SEQ ID NO: 1289 - protein, 15 aa, Homo sapiens
GQRPGFGYGGRASDY

SEQ ID NO: 1290 - protein, 15 aa, Homo sapiens
ILDSIGRFFGGDRGA

SEQ ID NO: 1291 - protein, 15 aa, Homo sapiens
PKRGSGKDSHHPART

SEQ ID NO: 1292 - protein, 21 aa, Homo sapiens
YLASASTMDHARHGFLPRRHR

SEQ ID NO: 1293 - protein, 26 aa, Zea mays
FTGASMNPARSFGPALATGDWTNHWV

SEQ ID NO: 1294 - protein, 26 aa, Homo sapiens
YTGASMNPARSFGPAVIMGNWENHWI

SEQ ID NO: 1295 - protein, 20 aa, Triticum aestivum
AMCNVYIPPYCAMAPFGIFG

SEQ ID NO: 1296 - protein, 8 aa, Triticum aestivum
ELPYPQPQ

SEQ ID NO: 1297 - protein, 8 aa, Triticum aestivum
FPQPELPY

SEQ ID NO: 1298 - protein, 10 aa, Triticum aestivum
FPQPQPFPPQ

SEQ ID NO: 1299 - protein, 10 aa, Triticum aestivum
FPQPQQQFPQ

SEQ ID NO: 1300 - protein, 13 aa, Triticum aestivum
FPQQPQQPFPQQP

SEQ ID NO: 1301 - protein, 12 aa, Triticum aestivum
FPQQPQQPYPQQ

SEQ ID NO: 1302 - protein, 13 aa, Triticum aestivum
FPQQPQQPYPQQP

SEQ ID NO: 1303 - protein, 13 aa, Triticum aestivum
FPQQPQQPYPQQP

SEQ ID NO: 1304 - protein, 15 aa, Triticum aestivum
FPQQPQQPYPQQPQQ

SEQ ID NO: 1305 - protein, 10 aa, Triticum aestivum
FPSQQPYLQL

SEQ ID NO: 1306 - protein, 12 aa, Unknown
  epitope involved in celiac disease
FSQPEQEFPQPQ

SEQ ID NO: 1307 - protein, 12 aa, Triticum aestivum
FSQPQQQFPQPQ

SEQ ID NO: 1308 - protein, 11 aa, Unknown
  eptiope involved in celiac disease
GIIQPEQPAQL

SEQ ID NO: 1309 - protein, 11 aa, Triticum aestivum
GIIQPQQPAQL

SEQ ID NO: 1310 - protein, 15 aa, Triticum aestivum
GSFQPSQQNPQAQGS

SEQ ID NO: 1311 - protein, 20 aa, Triticum aestivum
HQPQQTFPQPQQTYPHQPQQ

SEQ ID NO: 1312 - protein, 20 aa, Triticum aestivum
IHSVAHSIIMQQEQQQGVPI

SEQ ID NO: 1313 - protein, 10 aa, Unknown
  epitope involved in celiac disease
IIQPEQPAQL

SEQ ID NO: 1314 - protein, 9 aa, Triticum aestivum
IIQPQQPAQ

SEQ ID NO: 1315 - protein, 10 aa, Triticum aestivum
IIQPQQPAQL

SEQ ID NO: 1316 - protein, 20 aa, Triticum aestivum
LGIIQPQQPAQLEGIRSLVL

SEQ ID NO: 1317 - protein, 12 aa, Triticum aestivum
LGQGSFRPSQQN

SEQ ID NO: 1318 - protein, 17 aa, Triticum aestivum
LGQQQPFPPQQPYPQPQ

SEQ ID NO: 1319 - protein, 19 aa, Triticum aestivum
LGQQQPFPPQQPYPQPQPF

SEQ ID NO: 1320 - protein, 20 aa, Unknown
  epitope involved in celiac disease
LQLQPFPQPEKPYPQPEKPY

SEQ ID NO: 1321 - protein, 20 aa, Unknown
  epitope involved in celiac disease
LQLQPFPQPEKPYPQPELPY

SEQ ID NO: 1322 - protein, 20 aa, Unknown
  epitope involved in celiac disease
LQLQPFPQPEKPYPQPELPY

SEQ ID NO: 1323 - protein, 20 aa, Unknown
  epitope involved in celiac disease
LQLQPFPQPELPYPQPEKPY

SEQ ID NO: 1324 - protein, 20 aa, Unknown
  epitope involved in celiac disease
LQLQPFPQPELPYPQPELPY

SEQ ID NO: 1325 - protein, 33 aa, Unknown
  epitope involved in celiac disease
LQLQPFPQPELPYPQPELPYPQPELPYPQPQPF

SEQ ID NO: 1326 - protein, 13 aa, Triticum aestivum
LQLQPFPQPQLPY

SEQ ID NO: 1327 - protein, 13 aa, Triticum aestivum
LQLQPFPQPQLPY

SEQ ID NO: 1328 - protein, 20 aa, Triticum aestivum
LQLQPFPQPQLPYPQPQLPY

SEQ ID NO: 1329 - protein, 20 aa, Triticum aestivum
LQLQPFPQPQLPYPQPQLPY

SEQ ID NO: 1330 - protein, 32 aa, Unknown
  epitope involved in celiac disease
LQLQPFPQPQLPYPQPQLPYPQPQLPYPQPPF

SEQ ID NO: 1331 - protein, 33 aa, Triticum aestivum
LQLQPFPQPQLPYPQPQLPYPQPQLPYPQPQPF

SEQ ID NO: 1332 - protein, 8 aa, Triticum aestivum
LQPFPQPE

SEQ ID NO: 1333 - protein, 11 aa, Unknown
  epitope involved in celiac disease
LQPFPQPELPY

SEQ ID NO: 1334 - protein, 11 aa, Triticum aestivum
LQPFPQPQLPY

SEQ ID NO: 1335 - protein, 20 aa, Triticum aestivum
LQPQQPFPQQPQQPYPQQPQ

SEQ ID NO: 1336 - protein, 20 aa, Triticum aestivum
LRPLFQLAQGLGIIQPQQPA

SEQ ID NO: 1337 - protein, 12 aa, Human adenovirus 12
LRRGMFRPSQCN

SEQ ID NO: 1338 - protein, 8 aa, Triticum aestivum
PELPYPQP

SEQ ID NO: 1339 - protein, 14 aa, Unknown
  epitope involved in celiac disease
PEQPQQSFPEQERP

SEQ ID NO: 1340 - protein, 8 aa, Triticum aestivum
PFPQPELP

SEQ ID NO: 1341 - protein, 9 aa, Triticum aestivum
PFPQPQLPY

SEQ ID NO: 1342 - protein, 15 aa, Triticum aestivum
PFPQPQLPYPQPQLP

SEQ ID NO: 1343 - protein, 20 aa, Triticum aestivum
PFPQPQQTFPQQPQLPFPQQ

SEQ ID NO: 1344 - protein, 20 aa, Triticum aestivum
PFPQQPQQPFPQQPQQSFPQ

SEQ ID NO: 1345 - protein, 14 aa, Triticum aestivum
PFRPQQPYPQPQPQ

SEQ ID NO: 1346 - protein, 8 aa, Triticum aestivum
PFSQQQQQ

SEQ ID NO: 1347 - protein, 10 aa, Triticum aestivum
PFSQQQQSPF

SEQ ID NO: 1348 - protein, 20 aa, Triticum aestivum
PFTQPQQPTPIQPQQPFPQQ

SEQ ID NO: 1349 - protein, 8 aa, Triticum aestivum
PQPELPYP

SEQ ID NO: 1350 - protein, 9 aa, Unknown
  epitope involved in celiac disease
PQPELPYPQ

SEQ ID NO: 1351 - protein, 11 aa, Unknown
  epitope involved in celiac disease
PQPELPYPQPE

SEQ ID NO: 1352 - protein, 14 aa, Unknown
  epitope involved in celiac disease
PQPELPYPQPELPY

SEQ ID NO: 1353 - protein, 14 aa, Unknown
  epitope involved in celiac disease
PQPELPYPQPQLPY

SEQ ID NO: 1354 - protein, 9 aa, Triticum aestivum
PQPQLPYPQ

SEQ ID NO: 1355 - protein, 12 aa, Triticum aestivum
PQPQLPYPQPQL

SEQ ID NO: 1356 - protein, 14 aa, Triticum aestivum
PQPQLPYPQPQLPY

SEQ ID NO: 1357 - protein, 14 aa, Triticum aestivum
PQPQLPYPQPQLPY

SEQ ID NO: 1358 - protein, 14 aa, Triticum aestivum
PQPQLPYPQPQLPY

SEQ ID NO: 1359 - protein, 20 aa, Triticum aestivum
PQPQQPQLPFPQQPQQPFPQ

SEQ ID NO: 1360 - protein, 5 aa, Triticum aestivum
PQQPF

SEQ ID NO: 1361 - protein, 20 aa, Triticum aestivum
PQQPFPQPQQPQQPFPQSQQ

SEQ ID NO: 1362 - protein, 20 aa, Triticum aestivum
PQQPFPQPQQQFPQPQQPQQ

SEQ ID NO: 1363 - protein, 11 aa, Triticum aestivum
PQQPFPQQPQQ

SEQ ID NO: 1364 - protein, 11 aa, Triticum aestivum
PQQPFPQQPQQ

SEQ ID NO: 1365 - protein, 17 aa, Triticum aestivum
PQQPFPQQPQQPYPQQP

SEQ ID NO: 1366 - protein, 20 aa, Triticum aestivum
PQQPFPQSQQPQQPFPQPQQ

SEQ ID NO: 1367 - protein, 20 aa, Triticum aestivum
PQQPQQPFPLQPQQPFPQQP

SEQ ID NO: 1368 - protein, 14 aa, Triticum aestivum
PQQPQQSFPQQQRP

SEQ ID NO: 1369 - protein, 14 aa, Triticum aestivum
PQQPQQSFPQQQRP

SEQ ID NO: 1370 - protein, 9 aa, Triticum aestivum
PQQSFPEQE

SEQ ID NO: 1371 - protein, 9 aa, Triticum aestivum
PQQSFPQQQ

SEQ ID NO: 1372 - protein, 14 aa, Triticum aestivum
PQTQQPQQPFPQPQ

SEQ ID NO: 1373 - protein, 15 aa, Triticum aestivum
PSGQGSFQPSQQNPQ

SEQ ID NO: 1374 - protein, 9 aa, Triticum aestivum
PYPQPQLPY

SEQ ID NO: 1375 - protein, 9 aa, Triticum aestivum
PYPQPQLPY

SEQ ID NO: 1376 - protein, 15 aa, Triticum aestivum
QAQGSVQPQQLPQFE

SEQ ID NO: 1377 - protein, 20 aa, Triticum aestivum
QFPQPQQPQQSFPQQQQPAI

SEQ ID NO: 1378 - protein, 20 aa, Triticum aestivum
QFPQTQQPQQPFPQPQQTFP

SEQ ID NO: 1379 - protein, 10 aa, Triticum aestivum
QFQGQQQPFP

SEQ ID NO: 1380 - protein, 15 aa, Aegilops markgrafii
QGQQGYYPTSPQQSG

SEQ ID NO: 1381 - protein, 10 aa, Triticum aestivum
QGQQQPFPPQ

SEQ ID NO: 1382 - protein, 10 aa, Triticum aestivum
QLIPCMDVVL

SEQ ID NO: 1383 - protein, 13 aa, Triticum aestivum
QLPYPQPQLPYPQ

SEQ ID NO: 1384 - protein, 15 aa, Triticum aestivum
QLPYPQPQLPYPQPQ

SEQ ID NO: 1385 - protein, 8 aa, Triticum aestivum
QLQPFPQP

SEQ ID NO: 1386 - protein, 12 aa, Triticum aestivum
QLQPFPQPELPY

SEQ ID NO: 1387 - protein, 17 aa, Triticum aestivum
QLQPFPQPELPYPQPQS

SEQ ID NO: 1388 - protein, 17 aa, Triticum aestivum
QLQPFPQPELPYPQPQS

SEQ ID NO: 1389 - protein, 12 aa, Triticum aestivum
QLQPFPQPQLPY

SEQ ID NO: 1390 - protein, 12 aa, Triticum aestivum
QLQPFPQPQLPY

SEQ ID NO: 1391 - protein, 16 aa, Triticum aestivum
QLQPFPQPQLPYPQPQ

SEQ ID NO: 1392 - protein, 17 aa, Triticum aestivum
QLQPFPQPQLPYPQPQL

SEQ ID NO: 1393 - protein, 17 aa, Triticum aestivum
QLQPFPQPQLPYPQPQP

SEQ ID NO: 1394 - protein, 17 aa, Triticum aestivum
QLQPFPQPQLPYPQPQS

SEQ ID NO: 1395 - protein, 8 aa, Triticum aestivum
QPELPYPQ

SEQ ID NO: 1396 - protein, 8 aa, Triticum aestivum
QPFPQPEL

SEQ ID NO: 1397 - protein, 10 aa, Unknown
  epitope involved in celiac disease
QPFPQPELPY

SEQ ID NO: 1398 - protein, 10 aa, Triticum aestivum
QPFPQPQLPY

SEQ ID NO: 1399 - protein, 10 aa, Triticum aestivum
QPFPSQQPYL

SEQ ID NO: 1400 - protein, 13 aa, Triticum aestivum
QPQLPFPQQPQQP

SEQ ID NO: 1401 - protein, 15 aa, Triticum aestivum
QPQLPYPQPQLPYPQ

SEQ ID NO: 1402 - protein, 10 aa, Triticum aestivum
QPQPFPPQLP

SEQ ID NO: 1403 - protein, 21 aa, Triticum aestivum
QPQPFPQQSEQSQQPFQPQPF

SEQ ID NO: 1404 - protein, 10 aa, Triticum aestivum
QPQPFPSQQP

SEQ ID NO: 1405 - protein, 20 aa, Triticum aestivum
QPQPFRPQQPYPQPQPQYSQ

SEQ ID NO: 1406 - protein, 10 aa, Unknown
  epitope involved in celiac disease
QPQPQFPEQQ

SEQ ID NO: 1407 - protein, 19 aa, Triticum aestivum
QPQQPFPQQPQQPYPQQPQ

SEQ ID NO: 1408 - protein, 13 aa, Triticum aestivum
QPQQPIPVQPQQS

SEQ ID NO: 1409 - protein, 20 aa, Triticum aestivum
QPQQPIPVQPQQSFPQQSQQ

SEQ ID NO: 1410 - protein, 20 aa, Triticum aestivum
QPQQPQQPFPQQQQPLIQPY

SEQ ID NO: 1411 - protein, 16 aa, Triticum aestivum
QPQQPQQSFPQQQRPF

SEQ ID NO: 1412 - protein, 20 aa, Triticum aestivum
QPQQQYPSGQGSFQPSQQNP

SEQ ID NO: 1413 - protein, 10 aa, Triticum aestivum
QPQQSFPQQQ

SEQ ID NO: 1414 - protein, 12 aa, Triticum aestivum
QPQQSFPQQQRP

SEQ ID NO: 1415 - protein, 10 aa, Unknown
  epitope involved in celiac disease
QPQQTFPEQA

SEQ ID NO: 1416 - protein, 10 aa, Triticum aestivum
QPYPQPQPQY

SEQ ID NO: 1417 - protein, 20 aa, Triticum aestivum
QQFLQPQQPFPQQPQQPYPQ

SEQ ID NO: 1418 - protein, 13 aa, Triticum aestivum
QQGYYPTSPQQSG

SEQ ID NO: 1419 - protein, 20 aa, Triticum aestivum
QQLPQPQQPQQSFPQQQRPF

SEQ ID NO: 1420 - protein, 20 aa, Triticum aestivum
QQPFCQQPQRTIPQPHQTFH

SEQ ID NO: 1421 - protein, 5 aa, Triticum aestivum
QQPFP

SEQ ID NO: 1422 - protein, 20 aa, Triticum aestivum
QQPFPQQPQQPFPQPQQPIP

SEQ ID NO: 1423 - protein, 20 aa, Triticum aestivum
QQPLPQPQQPQQPFPQSQQP

SEQ ID NO: 1424 - protein, 15 aa, Triticum aestivum
QQPPFSQQQQQPLPQ

SEQ ID NO: 1425 - protein, 10 aa, Triticum durum
QQPQDAVQPF

SEQ ID NO: 1426 - protein, 20 aa, Triticum aestivum
QQPQLPFPQQPQQPFPQPQQ

SEQ ID NO: 1427 - protein, 20 aa, Triticum aestivum
QQPYPQPQPFPSQQPYLQLQ

SEQ ID NO: 1428 - protein, 20 aa, Triticum aestivum
QQQFIQPQQPFPQQPQQTYP

SEQ ID NO: 1429 - protein, 10 aa, Triticum aestivum
QQQPFPPQQP

SEQ ID NO: 1430 - protein, 20 aa, Triticum aestivum
QQQQPPFSQQQQSPFSQQQQ

SEQ ID NO: 1431 - protein, 20 aa, Triticum aestivum
QQTYPHQPQQQFPQTQQPQQ

SEQ ID NO: 1432 - protein, 21 aa, Triticum aestivum
  misc_feature (3)..(3): Xaa can be any naturally occurring amino acid
  misc_feature (8)..(8): Xaa can be any naturally occurring amino acid
  misc_feature (14)..(14): Xaa can be any naturally occurring amino acid
QQXSQPQXPQQQQXPQQPQQF

SEQ ID NO: 1433 - protein, 19 aa, Triticum aestivum
QQYPLGQGSFRPSQQNPQA

SEQ ID NO: 1434 - protein, 12 aa, Triticum aestivum
QSEQSQQPFQPQ

SEQ ID NO: 1435 - protein, 20 aa, Triticum aestivum
QSFLQQQMNPCKNFLLQQCN

SEQ ID NO: 1436 - protein, 20 aa, Triticum aestivum
QTQQPQQPFPQQPQQPFPQT

SEQ ID NO: 1437 - protein, 20 aa, Triticum aestivum
QVPLVQQQQFLGQQQPFPPQ

SEQ ID NO: 1438 - protein, 9 aa, Triticum aestivum
  misc_feature (2)..(2): Xaa can be any naturally occurring amino acid
QXPQQPQQF

SEQ ID NO: 1439 - protein, 20 aa, Triticum aestivum
SFPQQQQPAIQSFLQQQMNP

SEQ ID NO: 1440 - protein, 10 aa, Triticum aestivum
SFQQPQQQYP

SEQ ID NO: 1441 - protein, 12 aa, Triticum aestivum
SGQGSFQPSQQN

SEQ ID NO: 1442 - protein, 14 aa, Triticum aestivum
SGQGSFQPSQQNPQ

SEQ ID NO: 1443 - protein, 20 aa, Triticum aestivum
SQQPYLQLQPFPQPQLPYSQ

SEQ ID NO: 1444 - protein, 20 aa, Triticum aestivum
TIPQPHQTFHHQPQQTFPQP

SEQ ID NO: 1445 - protein, 20 aa, Triticum aestivum
TPIQPQQPFPQQPQQPQQPF

SEQ ID NO: 1446 - protein, 15 aa, Triticum aestivum
VQGQGIIQPQQPAQL

SEQ ID NO: 1447 - protein, 20 aa, Triticum aestivum
VYIPPYCTIAPFGIFGTNYR

SEQ ID NO: 1448 - protein, 20 aa, Triticum aestivum
WPQQQPFPQPQQPFCQQPQR

SEQ ID NO: 1449 - protein, 15 aa, Triticum aestivum
YLQLQPFPQPQLPYP

SEQ ID NO: 1450 - protein, 15 aa, Triticum aestivum
YPQPQLPYPQPQPFR

SEQ ID NO: 1451 - protein, 10 aa, Triticum aestivum
YPQPQPFPSQ

SEQ ID NO: 1452 - protein, 15 aa, Triticum aestivum
YPSGQGSFQPSQQNP

SEQ ID NO: 1453 - protein, 21 aa, Triticum aestivum
YQQLPQPQQPQQSFPQQQRPF

SEQ ID NO: 1454 - protein, 14 aa, Unknown
  epitope involved in celiac disease
QLQPFPQPELPYPQ

SEQ ID NO: 1455 - protein, 11 aa, Triticum aestivum
GIIQPQQPAQL

SEQ ID NO: 1456 - protein, 9 aa, Triticum aestivum
IQPQQPAQL

SEQ ID NO: 1457 - protein, 15 aa, Triticum aestivum
QPQQPQQSFPQQQRP

SEQ ID NO: 1458 - protein, 9 aa, Triticum aestivum
QQPFPQQPQ

SEQ ID NO: 1459 - protein, 9 aa, Triticum aestivum
QQPQQPYPQ

SEQ ID NO: 1460 - protein, 9 aa, Triticum aestivum
SQPQQQFPQ

SEQ ID NO: 1461 - protein, 18 aa, Triticum aestivum
FLGQQQPFPPQQPYPQPQ

SEQ ID NO: 1462 - protein, 20 aa, Triticum aestivum
FPGQQQPFPPQQPYPQPQPF

SEQ ID NO: 1463 - protein, 12 aa, Triticum aestivum
LGQQQPFPPQQP

SEQ ID NO: 1464 - protein, 19 aa, Triticum aestivum
QFLGQQQPFPPQQPYPQPQ

SEQ ID NO: 1465 - protein, 18 aa, Triticum aestivum
QNPSQQQPQEQVPLVQQQ

SEQ ID NO: 1466 - protein, 19 aa, Triticum aestivum
VRVPVPQLQPQNPSQQQPQ

SEQ ID NO: 1467 - protein, 15 aa, Triticum aestivum
QPQQPQQSFPQQQRP

SEQ ID NO: 1468 - protein, 8 aa, Triticum aestivum
VRVPVPQL

SEQ ID NO: 1469 - protein, 20 aa, Unknown
  epitope involved in celiac disease
LQLQPFPQPELPYPQPELPY

SEQ ID NO: 1470 - protein, 11 aa, Unknown
  epitope involved in celiac disease
LQPFPQPELPY

SEQ ID NO: 1471 - protein, 14 aa, Avena sativa
QYQPYPEQQQPFVQ

SEQ ID NO: 1472 - protein, 19 aa, Avena sativa
SEQYQPYPEQQEPFVQQQQ

SEQ ID NO: 1473 - protein, 22 aa, Avena nuda
TTTVQYDPSEQYQPYPEQQEPF

SEQ ID NO: 1474 - protein, 22 aa, Avena sativa
TTTVQYNPSEQYQPYPEQQEPF

SEQ ID NO: 1475 - protein, 12 aa, Avena sativa
YQPYPEQQEPFV

SEQ ID NO: 1476 - protein, 17 aa, Triticum aestivum
FPQPQLPYPQPQSQVLQ

SEQ ID NO: 1477 - protein, 15 aa, Triticum aestivum
LQLQPFPQPQLPYPQ

SEQ ID NO: 1478 - protein, 10 aa, Homo sapiens
AAEKQMKDKQ

SEQ ID NO: 1479 - protein, 10 aa, Unknown
  epitope involved in celiac disease
AEDKEDDAED

SEQ ID NO: 1480 - protein, 10 aa, Homo sapiens
AKIDDPTDSK

SEQ ID NO: 1481 - protein, 10 aa, Unknown
  epitope involved in celiac disease
ASFAEAPFSN

SEQ ID NO: 1482 - protein, 10 aa, Unknown
  epitope involved in celiac disease
DAEDKDEDEE

SEQ ID NO: 1483 - protein, 10 aa, Homo sapiens
DEEDKEEDEE

SEQ ID NO: 1484 - protein, 10 aa, Unknown
  epitope involved in celiac disease
EDDAEDKDED

SEQ ID NO: 1485 - protein, 10 aa, Homo sapiens
EDEEDEEDKE

SEQ ID NO: 1486 - protein, 10 aa, Homo sapiens
EDKDEDEEDE

SEQ ID NO: 1487 - protein, 10 aa, Homo sapiens
EDKEEDEEED

SEQ ID NO: 1488 - protein, 10 aa, Homo sapiens
EDKKRKEEEE

SEQ ID NO: 1489 - protein, 10 aa, Unknown
  epitope involved in celiac disease
EEAEDKEDDA

SEQ ID NO: 1490 - protein, 10 aa, Homo sapiens
EEDEEDKEED

SEQ ID NO: 1491 - protein, 10 aa, Homo sapiens
EEEDKKRKEE

SEQ ID NO: 1492 - protein, 10 aa, Homo sapiens
EEEEAEDKED

SEQ ID NO: 1493 - protein, 10 aa, Homo sapiens
EKDKGLQTSQ

SEQ ID NO: 1494 - protein, 10 aa, Homo sapiens
EKQMKDKQDE

SEQ ID NO: 1495 - protein, 10 aa, Homo sapiens
EQRLKEEEED

SEQ ID NO: 1496 - protein, 10 aa, Unknown
  epitope involved in celiac disease
FAEAPFSNKG

SEQ ID NO: 1497 - protein, 10 aa, Homo sapiens
GLQTSQDARF

SEQ ID NO: 1498 - protein, 10 aa, Homo sapiens
GVTKAAEKQM

SEQ ID NO: 1499 - protein, 10 aa, Homo sapiens
IFDNFLITND

SEQ ID NO: 1500 - protein, 10 aa, Homo sapiens
KDEDEEDEED

SEQ ID NO: 1501 - protein, 10 aa, Homo sapiens
KEEEEDKKRK

SEQ ID NO: 1502 - protein, 10 aa, Homo sapiens
KGKNVLINKD

SEQ ID NO: 1503 - protein, 10 aa, Homo sapiens
KIKDPDASKP

SEQ ID NO: 1504 - protein, 10 aa, Homo sapiens
KLFPNSLDQT

SEQ ID NO: 1505 - protein, 10 aa, Homo sapiens
KQDEEQRLKE

SEQ ID NO: 1506 - protein, 10 aa, Homo sapiens
KSGTIFDNFL

SEQ ID NO: 1507 - protein, 10 aa, Homo sapiens
LPPKKIKDPD

SEQ ID NO: 1508 - protein, 10 aa, Homo sapiens
QVKSGTIFDN

SEQ ID NO: 1509 - protein, 10 aa, Homo sapiens
RKEEEEAEDK

SEQ ID NO: 1510 - protein, 10 aa, Homo sapiens
RLKEEEEDKK

SEQ ID NO: 1511 - protein, 10 aa, Homo sapiens
TKAAEKQMKD

SEQ ID NO: 1512 - protein, 21 aa, Triticum aestivum
AHGRSQVLQQSTYQLLQELCC

SEQ ID NO: 1513 - protein, 21 aa, Triticum aestivum
AQGSVQPQQLPQFEEIRNLAL

SEQ ID NO: 1514 - protein, 21 aa, Triticum aestivum
FCMDVVLQQHNIAHGRSQVLQ

SEQ ID NO: 1515 - protein, 18 aa, Triticum aestivum
HNIAHGRSQVLQQSTYQL

SEQ ID NO: 1516 - protein, 21 aa, Triticum aestivum
LCCQHLWQIPEQSQCQAIHNV

SEQ ID NO: 1517 - protein, 15 aa, Triticum aestivum
LPYSQPQPFRPQQPY

SEQ ID NO: 1518 - protein, 21 aa, Triticum aestivum
LPYSQPQPFRPQQPYPQPQPQ

SEQ ID NO: 1519 - protein, 21 aa, Triticum aestivum
LQQHNIAHGRSQVLQQSTYQL

SEQ ID NO: 1520 - protein, 21 aa, Triticum aestivum
LQQQLIFCMDVVLQQHNIAHG

SEQ ID NO: 1521 - protein, 21 aa, Triticum aestivum
MKTFLILALLAIVATTATTAV

SEQ ID NO: 1522 - protein, 21 aa, Triticum aestivum
PLVQQQQFLGQQQPFPPQQPY

SEQ ID NO: 1523 - protein, 18 aa, Triticum aestivum
PPQQPYPQPQPFPSQQPY

SEQ ID NO: 1524 - protein, 21 aa, Triticum aestivum
PQQPISQQQQQQQQQQQQQQQ

SEQ ID NO: 1525 - protein, 21 aa, Triticum aestivum
QFLGQQQPFPPQQPYPQPQPF

SEQ ID NO: 1526 - protein, 21 aa, Triticum aestivum
QGSFRPSQQNPQAQGSVQPQQ

SEQ ID NO: 1527 - protein, 21 aa, Triticum aestivum
QNPSQQQPQEQVPLVQQQQFL

SEQ ID NO: 1528 - protein, 21 aa, Triticum aestivum
QPFPPQLPYSQPQPFRPQQPY

SEQ ID NO: 1529 - protein, 21 aa, Triticum aestivum
QPFPPQQPYPQPQPFPSQQPY

SEQ ID NO: 1530 - protein, 11 aa, Triticum aestivum
QPFPQPQLPYP

SEQ ID NO: 1531 - protein, 21 aa, Triticum aestivum
QPFPQPQLPYSQPQPFRPQQP

SEQ ID NO: 1532 - protein, 21 aa, Triticum aestivum
QPFPSQQPYLQLQPFPQPQLP

SEQ ID NO: 1533 - protein, 21 aa, Triticum aestivum
QPFRPQQPYPQPQPQYSQPQQ

SEQ ID NO: 1534 - protein, 21 aa, Triticum aestivum
QPQEQVPLVQQQQFLGQQQPF

SEQ ID NO: 1535 - protein, 21 aa, Triticum aestivum
QPQYSQPQQPISQQQQQQQQQ

SEQ ID NO: 1536 - protein, 21 aa, Triticum aestivum
QPSSQVSFQQPLQQYPLGQGS

SEQ ID NO: 1537 - protein, 21 aa, Triticum aestivum
QPYLQLQPFPQPQLPYSQPQP

SEQ ID NO: 1538 - protein, 21 aa, Triticum aestivum
QPYPQPQPFPSQQPYLQLQPF

SEQ ID NO: 1539 - protein, 21 aa, Triticum aestivum
QPYPQPQPQYSQPQQPISQQQ

SEQ ID NO: 1540 - protein, 21 aa, Triticum aestivum
QQKQQQQPSSQVSFQQPLQQY

SEQ ID NO: 1541 - protein, 18 aa, Triticum aestivum
QQQQFLGQQQPFPPQQPY

SEQ ID NO: 1542 - protein, 18 aa, Triticum aestivum
QQQQPSSQVSFQQPLQQY

SEQ ID NO: 1543 - protein, 21 aa, Triticum aestivum
QQQQQQQQQQQQQILQQILQQ

SEQ ID NO: 1544 - protein, 21 aa, Triticum aestivum
QQQQQQQQQQQQQQQQQQQIL

SEQ ID NO: 1545 - protein, 10 aa, Triticum aestivum
QQRPFIQPSL

SEQ ID NO: 1546 - protein, 21 aa, Triticum aestivum
QQYPLGQGSFRPSQQNPQAQG

SEQ ID NO: 1547 - protein, 21 aa, Triticum aestivum
SFQQPLQQYPLGQGSFRPSQQ

SEQ ID NO: 1548 - protein, 21 aa, Triticum aestivum
SQCQAIHNVVHAIILHQQQQQ

SEQ ID NO: 1549 - protein, 21 aa, Triticum aestivum
SQQNPQAQGSVQPQQLPQFEE

SEQ ID NO: 1550 - protein, 21 aa, Triticum aestivum
TAVRVPVPQLQPQNPSQQQPQ

SEQ ID NO: 1551 - protein, 21 aa, Triticum aestivum
VLQQSTYQLLQELCCQHLWQI

SEQ ID NO: 1552 - protein, 21 aa, Triticum aestivum
VPQLQPQNPSQQQPQEQVPLV

SEQ ID NO: 1553 - protein, 21 aa, Triticum aestivum
YQLLQELCCQHLWQIPEQSQC

SEQ ID NO: 1554 - protein, 12 aa, Triticum aestivum
AHGRSQVLQQST

SEQ ID NO: 1555 - protein, 12 aa, Triticum aestivum
ALQTLPAMCNVY

SEQ ID NO: 1556 - protein, 12 aa, Triticum aestivum
AMCNVYIPPYCT

SEQ ID NO: 1557 - protein, 12 aa, Triticum aestivum
EEIRNLALQTLP

SEQ ID NO: 1558 - protein, 12 aa, Triticum aestivum
FPPQQPYPQPQP

SEQ ID NO: 1559 - protein, 12 aa, Triticum aestivum
FPQPQLPYSQPQ

SEQ ID NO: 1560 - protein, 12 aa, Triticum aestivum
FPSQQPYLQLQP

SEQ ID NO: 1561 - protein, 12 aa, Triticum aestivum
FQQPLQQYPLGQ

SEQ ID NO: 1562 - protein, 12 aa, Triticum aestivum
GSFRPSQQNPQA

SEQ ID NO: 1563 - protein, 12 aa, Triticum aestivum
HNVVHAIILHQQ

SEQ ID NO: 1564 - protein, 12 aa, Triticum aestivum
IILHQQQKQQQQ

SEQ ID NO: 1565 - protein, 12 aa, Triticum aestivum
IPPYCTIAPFGI

SEQ ID NO: 1566 - protein, 12 aa, Triticum aestivum
LCCQHLWQIPEQ

SEQ ID NO: 1567 - protein, 12 aa, Triticum aestivum
LQQHNIAHGRSQ

SEQ ID NO: 1568 - protein, 12 aa, Triticum aestivum
LQQQLIPCMDVV

SEQ ID NO: 1569 - protein, 12 aa, Triticum aestivum
PCMDVVLQQHNI

SEQ ID NO: 1570 - protein, 12 aa, Triticum aestivum
PFRPQQPYPQPQ

SEQ ID NO: 1571 - protein, 12 aa, Triticum aestivum
PQYSQPQQPISQ

SEQ ID NO: 1572 - protein, 12 aa, Triticum aestivum
PSQQQPQEQVPL

SEQ ID NO: 1573 - protein, 12 aa, Triticum aestivum
PSSQVSFQQPLQ

SEQ ID NO: 1574 - protein, 12 aa, Triticum aestivum
PYSQPQPFRPQQ

SEQ ID NO: 1575 - protein, 12 aa, Triticum aestivum
QEQVPLVQQQQF

SEQ ID NO: 1576 - protein, 12 aa, Triticum aestivum
QGSVQPQQLPQF

SEQ ID NO: 1577 - protein, 12 aa, Triticum aestivum
QILQQILQQQLI

SEQ ID NO: 1578 - protein, 12 aa, Triticum aestivum
QKQQQQPSSQVS

SEQ ID NO: 1579 - protein, 12 aa, Triticum aestivum
QLQPQNPSQQQP

SEQ ID NO: 1580 - protein, 12 aa, Triticum aestivum
QQNPQAQGSVQP

SEQ ID NO: 1581 - protein, 12 aa, Triticum aestivum
QQPISQQILQQI

SEQ ID NO: 1582 - protein, 12 aa, Triticum aestivum
QYPLGQGSFRPS

SEQ ID NO: 1583 - protein, 12 aa, Triticum aestivum
SQCQAIHNVVHA

SEQ ID NO: 1584 - protein, 11 aa, Triticum aestivum
TIAPFGIFGTN

SEQ ID NO: 1585 - protein, 12 aa, Triticum aestivum
VLQQSTYQLLQE

SEQ ID NO: 1586 - protein, 12 aa, Triticum aestivum
VQQQQFLGQQQP

SEQ ID NO: 1587 - protein, 12 aa, Triticum aestivum
WQIPEQSQCQAI

SEQ ID NO: 1588 - protein, 12 aa, Triticum aestivum
YLQLQPFPQPQL

SEQ ID NO: 1589 - protein, 12 aa, Triticum aestivum
YPQPQPFPSQQP

SEQ ID NO: 1590 - protein, 12 aa, Triticum aestivum
YQLLQELCCQHL

SEQ ID NO: 1591 - protein, 15 aa, Triticum aestivum
QLQPFPQPQLPYPQP

SEQ ID NO: 1592 - protein, 12 aa, Unknown
  epitope involved in celiac disease
FPQQPEQPYPQQ

SEQ ID NO: 1593 - protein, 15 aa, Triticum aestivum
GQGIIQPQQPAQLIR

SEQ ID NO: 1594 - protein, 33 aa, Triticum aestivum; identical to SEQ ID NO: 1331

SEQ ID NO: 1595 - protein, 9 aa, Triticum aestivum
PFPQPQLPY

SEQ ID NO: 1596 - protein, 15 aa, Triticum aestivum
PFPQQPQQPYPQQPQ

SEQ ID NO: 1597 - protein, 25 aa, Triticum aestivum
PQLPQFLQPQPYPQPQLPYPQPQPF

SEQ ID NO: 1598 - protein, 9 aa, Triticum aestivum
PQPQLPQPQ

SEQ ID NO: 1599 - protein, 17 aa, Triticum aestivum
PQPQPFLPQLPYPQPQS

SEQ ID NO: 1600 - protein, 17 aa, Triticum aestivum
PQPQPFPPQLPYPQPQS

SEQ ID NO: 1601 - protein, 14 aa, Triticum aestivum
PQQPFPSQQQQPLI

SEQ ID NO: 1602 - protein, 15 aa, Triticum aestivum
PQQPQQSFPQQQQPA

SEQ ID NO: 1603 - protein, 14 aa, Triticum aestivum
PQQQTLQPQQPAQL

SEQ ID NO: 1604 - protein, 15 aa, Triticum aestivum
QIPQQQQIPQQPQQF

SEQ ID NO: 1605 - protein, 17 aa, Triticum aestivum
QLQPFPQPTLPYPQPQS

SEQ ID NO: 1606 - protein, 18 aa, Triticum aestivum
QPQPYPQPQLPYPQPQPF

SEQ ID NO: 1607 - protein, 17 aa, Triticum aestivum
QPQQPFPQPQQPFPWQP

SEQ ID NO: 1608 - protein, 15 aa, Triticum aestivum
QQFSQPQQQFPQPQQ

SEQ ID NO: 1609 - protein, 18 aa, Unknown
  epitope involved in celiac disease
QYPSGEGSFQPSQENPQA

SEQ ID NO: 1610 - protein, 6 aa, Triticum aestivum
QQQPFP

SEQ ID NO: 1611 - protein, 8 aa, Homo sapiens
ASFEPFSN

SEQ ID NO: 1612 - protein, 8 aa, Homo sapiens
FEPFSNKG

SEQ ID NO: 1613 - protein, 9 aa, Triticum aestivum
PQPQLPYPQ

SEQ ID NO: 1614 - protein, 9 aa, Triticum aestivum
QGSFQPSQQ

SEQ ID NO: 1615 - protein, 18 aa, Triticum aestivum
QPQQPFPQPQQPFPWQPQ

SEQ ID NO: 1616 - protein, 9 aa, Triticum aestivum
QQPQQPFPQ

SEQ ID NO: 1617 - protein, 9 aa, Triticum aestivum
QQPQQPYPQ

SEQ ID NO: 1618 - protein, 13 aa, Triticum aestivum
LGEGSFQPSQENP

SEQ ID NO: 1619 - protein, 15 aa, Triticum aestivum
LQPFPQPQLPYPQPQ

SEQ ID NO: 1620 - protein, 15 aa, Triticum aestivum
LQPFPQPQLPYSQPQ

SEQ ID NO: 1621 - protein, 16 aa, Triticum aestivum
QLQPFPHPQLPYPHPQ

SEQ ID NO: 1622 - protein, 16 aa, Triticum aestivum
QLQPFPHPQLPYPQPQ

SEQ ID NO: 1623 - protein, 16 aa, Triticum aestivum
QLQPFPQAQLPYSQPQ

SEQ ID NO: 1624 - protein, 16 aa, Triticum aestivum
QLQPFPQPQLPYPQPE

SEQ ID NO: 1625 - protein, 16 aa, Triticum aestivum
QLQPFPQPQLPYPQPQ

SEQ ID NO: 1626 - protein, 16 aa, Triticum aestivum
QLQPFPQPQLPYSQPE

SEQ ID NO: 1627 - protein, 16 aa, Triticum aestivum
QLQPFPQPQLPYSQPQ

SEQ ID NO: 1628 - protein, 14 aa, Aegilops tauschii
QLQPFPQPQLPYTH

SEQ ID NO: 1629 - protein, 16 aa, Triticum aestivum
QLQPFSQPQLPYSQPQ

SEQ ID NO: 1630 - protein, 17 aa, Triticum aestivum
QLQRPFPQPQLPYPQPE

SEQ ID NO: 1631 - protein, 15 aa, Triticum aestivum
QPFRPQQPYPQPQPQ

SEQ ID NO: 1632 - protein, 15 aa, Triticum aestivum
QPQPFLPQLPYPQPE

SEQ ID NO: 1633 - protein, 15 aa, Triticum aestivum
QPQPFQPQLPYPQPE

SEQ ID NO: 1634 - protein, 14 aa, Triticum aestivum
PQTQQPQQPFPQPQ

SEQ ID NO: 1635 - protein, 20 aa, Triticum aestivum
FEEIRNLALQTLPAMCNVYI

SEQ ID NO: 1636 - protein, 20 aa, Triticum aestivum
FLGQQQSFPPQQPYPQPQPF

SEQ ID NO: 1637 - protein, 17 aa, Triticum aestivum
PPYCTIVPFGIFGTNYR

SEQ ID NO: 1638 - protein, 20 aa, Triticum aestivum
QLIPCMDVVLQQHNIAHGRS

SEQ ID NO: 1639 - protein, 20 aa, Triticum aestivum
QVLQQSTYQLLQELCCQHLW

SEQ ID NO: 1640 - protein, 4 aa, Triticum aestivum
FFQP

SEQ ID NO: 1641 - protein, 8 aa, Triticum aestivum
IILHQQHH

SEQ ID NO: 1642 - protein, 4 aa, Triticum aestivum
IPEQ

SEQ ID NO: 1643 - protein, 8 aa, Triticum aestivum
PLVQEQQF

SEQ ID NO: 1644 - protein, 6 aa, Triticum aestivum
PQQLPQ

SEQ ID NO: 1645 - protein, 6 aa, Triticum aestivum
QGFFQP

SEQ ID NO: 1646 - protein, 6 aa, Triticum aestivum
QGSFQP

SEQ ID NO: 1647 - protein, 6 aa, Triticum aestivum
QLQPFP

SEQ ID NO: 1648 - protein, 6 aa, Triticum aestivum
QPQPFP

SEQ ID NO: 1649 - protein, 6 aa, Triticum aestivum
QPQQPF

SEQ ID NO: 1650 - protein, 8 aa, Triticum aestivum
QVPLVQEQ

SEQ ID NO: 1651 - protein, 6 aa, Triticum aestivum
WQIPEQ

SEQ ID NO: 1652 - protein, 11 aa, Triticum aestivum
PQPQLPYPQPQ

SEQ ID NO: 1653 - protein, 10 aa, Triticum aestivum
FPPQQPYPQP

SEQ ID NO: 1654 - protein, 10 aa, Triticum aestivum
LQQQQQQQQQ

SEQ ID NO: 1655 - protein, 10 aa, Triticum aestivum
PQQPYPQPQP

SEQ ID NO: 1656 - protein, 10 aa, Triticum aestivum
QKQQLQQQQQ

SEQ ID NO: 1657 - protein, 10 aa, Triticum aestivum
QLQPFPQPQP

SEQ ID NO: 1658 - protein, 10 aa, Triticum aestivum
QPFPQPQPFP

SEQ ID NO: 1659 - protein, 10 aa, Triticum aestivum
QPYLQLQPFP

SEQ ID NO: 1660 - protein, 10 aa, Triticum aestivum
QPYPQPQPFP

SEQ ID NO: 1661 - protein, 10 aa, Triticum aestivum
QQQQQILQQI

SEQ ID NO: 1662 - protein, 10 aa, Triticum aestivum
QQQQQQLQQQ

SEQ ID NO: 1663 - protein, 10 aa, Triticum aestivum
QQQQQQQILQ

SEQ ID NO: 1664 - protein, 10 aa, Triticum aestivum
QQQQQQQQLQ

SEQ ID NO: 1665 - protein, 10 aa, Triticum aestivum
QQQQQQQQQI

SEQ ID NO: 1666 - protein, 10 aa, Triticum aestivum
QVSFQQPQQQ

SEQ ID NO: 1667 - protein, 10 aa, Triticum aestivum
RDVVLQQHNI

SEQ ID NO: 1668 - protein, 10 aa, Triticum aestivum
RNLALQTLPA

SEQ ID NO: 1669 - protein, 10 aa, Triticum aestivum
SQQPYLQLQP

SEQ ID NO: 1670 - protein, 10 aa, Triticum aestivum
YLQLQPFPQP

SEQ ID NO: 1671 - protein, 10 aa, Triticum aestivum
CQQLWQIPEQ

SEQ ID NO: 1672 - protein, 10 aa, Triticum aestivum
FEEIRNLALQ

SEQ ID NO: 1673 - protein, 10 aa, Triticum aestivum
FLPQQPYPQP

SEQ ID NO: 1674 - protein, 10 aa, Triticum aestivum
FQPQQLPQFE

SEQ ID NO: 1675 - protein, 10 aa, Triticum aestivum
GSFQPQQLPQ

SEQ ID NO: 1676 - protein, 10 aa, Triticum aestivum
IAPFGIFGTN

SEQ ID NO: 1677 - protein, 10 aa, Triticum aestivum
LPYPQPQPFL

SEQ ID NO: 1678 - protein, 10 aa, Triticum aestivum
LSQVSFQQPQ

SEQ ID NO: 1679 - protein, 10 aa, Triticum aestivum
PLVQEQQFQG

SEQ ID NO: 1680 - protein, 10 aa, Triticum aestivum
PQFEEIRNLA

SEQ ID NO: 1681 - protein, 10 aa, Triticum aestivum
PQQLPQFEEI

SEQ ID NO: 1682 - protein, 10 aa, Triticum aestivum
PQQPISQQQQ

SEQ ID NO: 1683 - protein, 10 aa, Triticum aestivum
PQQQYPSGQG

SEQ ID NO: 1684 - protein, 10 aa, Triticum aestivum
QEQVPLVQEQ

SEQ ID NO: 1685 - protein, 10 aa, Triticum aestivum
QESTYQLVQQ

SEQ ID NO: 1686 - protein, 10 aa, Triticum aestivum
QGFFQPSQQN

SEQ ID NO: 1687 - protein, 10 aa, Triticum aestivum
QLPQFEEIRN

SEQ ID NO: 1688 - protein, 10 aa, Triticum aestivum
QLQLQNPSQQ

SEQ ID NO: 1689 - protein, 10 aa, Triticum aestivum
QLWQIPEQSR

SEQ ID NO: 1690 - protein, 10 aa, Triticum aestivum
QPFLPQQPYP

SEQ ID NO: 1691 - protein, 10 aa, Triticum aestivum
QPFPPQQPYP

SEQ ID NO: 1692 - protein, 10 aa, Triticum aestivum
QPISQQQQQQ

SEQ ID NO: 1693 - protein, 10 aa, Triticum aestivum
QPLSQVSFQQ

SEQ ID NO: 1694 - protein, 10 aa, Triticum aestivum
QPQPFLPQQP

SEQ ID NO: 1695 - protein, 10 aa, Triticum aestivum
QPQYSQPQQP

SEQ ID NO: 1696 - protein, 10 aa, Triticum aestivum
QQHHHHQEQK

SEQ ID NO: 1697 - protein, 10 aa, Triticum aestivum
QQPQQQYPSG

SEQ ID NO: 1698 - protein, 10 aa, Triticum aestivum
QQQPLSQVSF

SEQ ID NO: 1699 - protein, 10 aa, Triticum aestivum
QQQQQPLSQV

SEQ ID NO: 1700 - protein, 10 aa, Triticum aestivum
QQQQQQQPLS

SEQ ID NO: 1701 - protein, 10 aa, Triticum aestivum
QQYPSGQGFF

SEQ ID NO: 1702 - protein, 10 aa, Triticum aestivum
QVPLVQEQQF

SEQ ID NO: 1703 - protein, 10 aa, Triticum aestivum
QYSQPQQPIS

SEQ ID NO: 1704 - protein, 10 aa, Triticum aestivum
SGQGFFQPSQ

SEQ ID NO: 1705 - protein, 10 aa, Triticum aestivum
SQPQQPISQQ

SEQ ID NO: 1706 - protein, 10 aa, Triticum aestivum
STTIAPFGIF

SEQ ID NO: 1707 - protein, 10 aa, Triticum aestivum
TIAPFGIFGT

SEQ ID NO: 1708 - protein, 10 aa, Triticum aestivum
VLQESTYQLV

SEQ ID NO: 1709 - protein, 10 aa, Triticum aestivum
VPQLQLQNPS

SEQ ID NO: 1710 - protein, 10 aa, Triticum aestivum
VPVPQLQLQN

SEQ ID NO: 1711 - protein, 10 aa, Triticum aestivum
VRVPVPQLQL

SEQ ID NO: 1712 - protein, 10 aa, Triticum aestivum
WQIPEQSRCQ

SEQ ID NO: 1713 - protein, 10 aa, Triticum aestivum
YPQPQPFLPQ

SEQ ID NO: 1714 - protein, 10 aa, Triticum aestivum
YPSGQGFFQP

SEQ ID NO: 1715 - protein, 12 aa, Triticum aestivum
FPQPQQQFPQPQ

SEQ ID NO: 1716 - protein, 12 aa, Triticum aestivum
FPQQPQQPYPQQ

SEQ ID NO: 1717 - protein, 20 aa, Triticum aestivum
LQPQQPFPQQPQQPYPQQPQ

SEQ ID NO: 1718 - protein, 18 aa, Triticum aestivum
PHQPQQQVPQPQQPQQPF

SEQ ID NO: 1719 - protein, 14 aa, Triticum aestivum
PQQPQQSFPQQQRP

SEQ ID NO: 1720 - protein, 17 aa, Triticum aestivum
QPQQPFPQPQQPFPWQP

SEQ ID NO: 1721 - protein, 23 aa, Secale strictum
QQPFPQQPQQPYPQQPQQPFPQP

SEQ ID NO: 1722 - protein, 19 aa, Triticum aestivum
SHQQQPFPQQPYPQQPYPS

SEQ ID NO: 1723 - protein, 9 aa, Triticum aestivum
EGSFQPSQE

SEQ ID NO: 1724 - protein, 9 aa, Triticum aestivum
QGYYPTSPQ

SEQ ID NO: 1725 - protein, 687 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 1726 - protein, 15 aa, Unknown
  epitope involved in celiac disease
FPEQPQQPYPQQPQQ

SEQ ID NO: 1727 - protein, 14 aa, Unknown
  epitope involved in celiac disease
PQTEQPQQPFPQPQ

SEQ ID NO: 1728 - protein, 13 aa, Unknown
  epitope involved in celiac disease
QEGYYPTSPEQSG

SEQ ID NO: 1729 - protein, 13 aa, Unknown
  epitope involved in celiac disease
QEGYYPTSPQQSG

SEQ ID NO: 1730 - protein, 13 aa, Unknown
  epitope involved in celiac disease
QQGYYPTSPEQSG

SEQ ID NO: 1731 - protein, 14 aa, Unknown
  epitope involved in celiac disease
SGEGSFQPSQQNPQ

SEQ ID NO: 1732 - protein, 12 aa, Unknown
  epitope involved in celiac disease
QLQPFSQPQLPY

SEQ ID NO: 1733 - protein, 15 aa, Unknown
  epitope involved in celiac disease
QQPPFAEQEQPVLPQ

SEQ ID NO: 1734 - protein, 15 aa, Unknown
  epitope involved in celiac disease
QQPPFGEQEQPVLPQ

SEQ ID NO: 1735 - protein, 15 aa, Triticum aestivum
QQPPFSQQQQPVLPQ

SEQ ID NO: 1736 - protein, 15 aa, Triticum aestivum
QQPPFSQQQQQPLPQ

SEQ ID NO: 1737 - protein, 20 aa, Triticum aestivum
QQQQPPFSQQQQSPFSQQQQ

SEQ ID NO: 1738 - protein, 14 aa, Unknown
  epitope involved in celiac disease
AQPEQPEQPFPQPQ

SEQ ID NO: 1739 - protein, 14 aa, Unknown
  epitope involved in celiac disease
KQPEQPEQPFPQPQ

SEQ ID NO: 1740 - protein, 14 aa, Unknown
  epitope involved in celiac disease
PAPEQPEQPFPQPQ

SEQ ID NO: 1741 - protein, 14 aa, Unknown
  epitope involved in celiac disease
PKPEQPEQPFPQPQ

SEQ ID NO: 1742 - protein, 14 aa, Unknown
  epitope involved in celiac disease
PQAEQPEQPFPQPQ

SEQ ID NO: 1743 - protein, 14 aa, Unknown
  epitope involved in celiac disease
PQKEQPEQPFPQPQ

SEQ ID NO: 1744 - protein, 14 aa, Unknown
  epitope involved in celiac disease
PQPAQPEQPFPQPQ

SEQ ID NO: 1745 - protein, 14 aa, Unknown
  epitope involved in celiac disease
PQPEAPEQPFPQPQ

SEQ ID NO: 1746 - protein, 14 aa, Unknown
  epitope involved in celiac disease
PQPEQAEQPFPQPQ

SEQ ID NO: 1747 - protein, 14 aa, Unknown
  epitope involved in celiac disease
PQPEQPAQPFPQPQ

SEQ ID NO: 1748 - protein, 14 aa, Unknown
  epitope involved in celiac disease
PQPEQPEAPFPQPQ

SEQ ID NO: 1749 - protein, 14 aa, Unknown
  epitope involved in celiac disease
PQPEQPEQAFPQPQ

SEQ ID NO: 1750 - protein, 14 aa, Unknown
  epitope involved in celiac disease
PQPEQPEQPAPQPQ

SEQ ID NO: 1751 - protein, 14 aa, Unknown
  epitope involved in celiac disease
PQPEQPEQPFAQPQ

SEQ ID NO: 1752 - protein, 14 aa, Unknown
  epitope involved in celiac disease
PQPEQPEQPFPAPQ

SEQ ID NO: 1753 - protein, 14 aa, Unknown
  epitope involved in celiac disease
PQPEQPEQPFPKPQ

SEQ ID NO: 1754 - protein, 14 aa, Unknown
  epitope involved in celiac disease
PQPEQPEQPFPQAQ

SEQ ID NO: 1755 - protein, 14 aa, Unknown
  epitope involved in celiac disease
PQPEQPEQPFPQKQ

SEQ ID NO: 1756 - protein, 14 aa, Unknown
  epitope involved in celiac disease
PQPEQPEQPFPQPA

SEQ ID NO: 1757 - protein, 14 aa, Unknown
  epitope involved in celiac disease
PQPEQPEQPFPQPK

SEQ ID NO: 1758 - protein, 14 aa, Unknown
  epitope involved in celiac disease
PQPEQPEQPFPQPQ

SEQ ID NO: 1759 - protein, 14 aa, Unknown
  epitope involved in celiac disease
PQPEQPQQPFPQPQ

SEQ ID NO: 1760 - protein, 14 aa, Unknown
  epitope involved in celiac disease
PQPQQPEQPFPQPQ

SEQ ID NO: 1761 - protein, 17 aa, Triticum aestivum
QPQQPQQPFPQQQQPLI

SEQ ID NO: 1762 - protein, 17 aa, Triticum aestivum
QPQQPQQSFPQQQQLMI

SEQ ID NO: 1763 - protein, 17 aa, Triticum aestivum
QPQQPQQSFPQQQQPAI

SEQ ID NO: 1764 - protein, 17 aa, Triticum aestivum
QPQQPQQSFPQQQQPLI

SEQ ID NO: 1765 - protein, 18 aa, Triticum aestivum
QQYPSGQGSFQPSQQNPQ

SEQ ID NO: 1766 - protein, 13 aa, Triticum aestivum
SGQGSFQPSQQNP

SEQ ID NO: 1767 - protein, 15 aa, Homo sapiens
CDGERPTLAFLQDVM

SEQ ID NO: 1768 - protein, 9 aa, Influenza A virus
CTELKLSDY

SEQ ID NO: 1769 - protein, 10 aa, Homo sapiens
DGVAVLKVGG

SEQ ID NO: 1770 - protein, 17 aa, Human coxsackievirus
EAIPALTAVETGHTSQV

SEQ ID NO: 1771 - protein, 17 aa, Mycobacterium tuberculosis
EGDEATGANIVKVALEA

SEQ ID NO: 1772 - protein, 9 aa, Influenza A virus
ELRSRYWAI

SEQ ID NO: 1773 - protein, 15 aa, Homo sapiens
FVNQHLCGSHLVEAL

SEQ ID NO: 1774 - protein, 20 aa, Coxsackievirus B4
GAHETSLSASGNSIIHYTNI

SEQ ID NO: 1775 - protein, 10 aa, Homo sapiens
GCALLRCIPA

SEQ ID NO: 1776 - protein, 10 aa, Mycobacterium bovis
GGVAVIKAGA

SEQ ID NO: 1777 - protein, 9 aa, Influenza A virus
GILGFVFTL

SEQ ID NO: 1778 - protein, 20 aa, Coxsackievirus B4
GNSIIHYTNINYYKDAASNS

SEQ ID NO: 1779 - protein, 10 aa, Mycobacterium bovis
GVTLLQAAPT

SEQ ID NO: 1780 - protein, 13 aa, Homo sapiens
IAFTSEHSHFSLK

SEQ ID NO: 1781 - protein, 9 aa, Influenza A virus
ILRGSVAHK

SEQ ID NO: 1782 - protein, 10 aa, Mycobacterium bovis
IVAGGGVTLL

SEQ ID NO: 1783 - protein, 10 aa, Homo sapiens
IVLGGGCALL

SEQ ID NO: 1784 - protein, 9 aa, Influenza A virus
IYSTVASSL

SEQ ID NO: 1785 - protein, 9 aa, Lymphocytic choriomeningitis virus
KAVYNFATC

SEQ ID NO: 1786 - protein, 14 aa, Human poliovirus
KEVPALTAVETGAT

SEQ ID NO: 1787 - protein, 12 aa, Coxsackievirus B4
KILPEVKEKHEF

SEQ ID NO: 1788 - protein, 10 aa, Mycobacterium bovis
LAKLAGGVAV

SEQ ID NO: 1789 - protein, 10 aa, Homo sapiens
LAKLSDGVAV

SEQ ID NO: 1790 - protein, 20 aa, Mus musculus
LVLNRLKVGLQVVAVKAPGF

SEQ ID NO: 1791 - protein, 20 aa, Coxsackievirus B4
MGAQVSTQKTGAHETSLSAS

SEQ ID NO: 1792 - protein, 20 aa, Homo sapiens
NMYAMMIARFKMFPEVKEKG

SEQ ID NO: 1793 - protein, 30 aa, Coxsackievirus B4
NYYKDAASNSANRQDFTQDPSKFTEPVKDV

SEQ ID NO: 1794 - protein, 13 aa, Influenza A virus
PKYVKQNTLKLAT

SEQ ID NO: 1795 - protein, 15 aa, Mycobacterium sp.
PYILLVSSKVSTVKD

SEQ ID NO: 1796 - protein, 14 aa, Clostridium tetani
QYIKANSKFIGITE

SEQ ID NO: 1797 - protein, 11 aa, Influenza A virus
SFERFEIFPKE

SEQ ID NO: 1798 - protein, 15 aa, Mus musculus
SHLVEALYLVCGERG

SEQ ID NO: 1799 - protein, 8 aa, Gallus gallus
SIINFEKL

SEQ ID NO: 1800 - protein, 19 aa, Coxsackievirus B4
SKFTEPVKDVMIKSLPALN

SEQ ID NO: 1801 - protein, 15 aa, Mus musculus
TYEIAPVFVLLEYVT

SEQ ID NO: 1802 - protein, 24 aa, Mycobacterium bovis
VAGGGVTLLQAAPTLDELKLEGDE

SEQ ID NO: 1803 - protein, 24 aa, Homo sapiens
VLGGGVALLRVIPALDSLTPANED

SEQ ID NO: 1804 - protein, 20 aa, Rubella virus
AFGHSDAACWGFPTDTVMSV

SEQ ID NO: 1805 - protein, 20 aa, Homo sapiens
EIIKRTLKIPAMTIAKNAGV

SEQ ID NO: 1806 - protein, 20 aa, Homo sapiens
GEVIVTKDDAMLLKGKGDKA

SEQ ID NO: 1807 - protein, 20 aa, Homo sapiens
IVLGGGCALLRCIPALDSLT

SEQ ID NO: 1808 - protein, 20 aa, Homo sapiens
KFGADARALMLQGVDLLADA

SEQ ID NO: 1809 - protein, 20 aa, Homo sapiens
LVIIAEDVDGEALSTLVLNR

SEQ ID NO: 1810 - protein, 21 aa, Rubella virus
PTDVSCEGLGAWVPTAPCARI

SEQ ID NO: 1811 - protein, 9 aa, Homo sapiens
VMAPRTVLL

SEQ ID NO: 1812 - protein, 19 aa, Homo sapiens
PGSGFWSFGSEDGSGDSEN

SEQ ID NO: 1813 - protein, 9 aa, Homo sapiens
ALWMRLLPL

SEQ ID NO: 1814 - protein, 9 aa, Homo sapiens
FLFAVGFYL

SEQ ID NO: 1815 - protein, 9 aa, Homo sapiens
FLIVLSVAL

SEQ ID NO: 1816 - protein, 9 aa, Homo sapiens
FLWSVFMLI

SEQ ID NO: 1817 - protein, 26 aa, Homo sapiens
FWYIPPSLRTLEDNEERMSRLSKVAP

SEQ ID NO: 1818 - protein, 13 aa, Homo sapiens
GAHGDTTPEYQDL

SEQ ID NO: 1819 - protein, 10 aa, Homo sapiens
GIVEQCCTSI

SEQ ID NO: 1820 - protein, 9 aa, Homo sapiens
HLVEALYLV

SEQ ID NO: 1821 - protein, 34 aa, Homo sapiens
HTNVCFWYIPPSLRTLEDNEERMSRLSKVAPVIK

SEQ ID NO: 1822 - protein, 13 aa, Homo sapiens
KERLAALGPEGAH

SEQ ID NO: 1823 - protein, 23 aa, Homo sapiens
KERLAALGPEGAHGDTTPEYQDL

SEQ ID NO: 1824 - protein, 9 aa, Homo sapiens
KLQVFLIVL

SEQ ID NO: 1825 - protein, 9 aa, Homo sapiens
LLPPLLEHL

SEQ ID NO: 1826 - protein, 6 aa, Homo sapiens
MASPGS

SEQ ID NO: 1827 - protein, 20 aa, Homo sapiens
MASPGSGFWSFGSEDGSGDS

SEQ ID NO: 1828 - protein, 13 aa, Homo sapiens
NFFRMVISNPAAT

SEQ ID NO: 1829 - protein, 13 aa, Unknown
  epitope involved in diabetes
NFIRMVISNPAAT

SEQ ID NO: 1830 - protein, 13 aa, Unknown
  epitope involved in diabetes
QPLALEGSLQSRG

SEQ ID NO: 1831 - protein, 9 aa, Homo sapiens
RLLCALTSL

SEQ ID NO: 1832 - protein, 15 aa, Homo sapiens
RTLEDNEERMSRLSK

SEQ ID NO: 1833 - protein, 9 aa, Homo sapiens
SLAAGVKLL

SEQ ID NO: 1834 - protein, 10 aa, Homo sapiens
SLQKRGIVEQ

SEQ ID NO: 1835 - protein, 9 aa, Homo sapiens
SLQPLALEG

SEQ ID NO: 1836 - protein, 15 aa, Homo sapiens
SLQPLALEGSLQKRG

SEQ ID NO: 1837 - protein, 15 aa, Unknown
  epitope involved in diabetes
SLQPLALEGSLQSRG

SEQ ID NO: 1838 - protein, 9 aa, Homo sapiens
SLSPLQAEL

SEQ ID NO: 1839 - protein, 9 aa, Homo sapiens
SLYQLENYC

SEQ ID NO: 1840 - protein, 3 aa, Homo sapiens
TSI

SEQ ID NO: 1841 - protein, 585 aa, Homo sapiens
MASPGSGFWSFGSEDGSGDSENPGTARAWCQVAQKFTGGIGNKLCALLYGDAEKPAESGGSQPPRAAARKAACACDQKPCSCSKVDVNYAFLHATDLLPACDGERPTLAFLQDVMNILLQYVVKSFDRSTKVIDFHYPNELLQEYNWELADQPQNLEEILMHCQTTLKYAIKTGHPRYFNQLSTGLDMVGLAADWLTSTANTNMFTYEIAPVFVLLEYVTLKKMREIIGWPGGSGDGIFSPGGAISNMYAMMIARFKMFPEVKEKGMAALPRLIAFTSEHSHFSLKKGAAALGIGTDSVILIKCDERGKMIPSDLERRILEAKQKGFVPFLVSATAGTTVYGAFDPLLAVADICKKYKIWMHVDAAWGGGLLMSRKHKWKLSGVERANSVTWNPHKMMGVPLQCSALLVREEGLMQNCNQMHASYLFQQDKHYDLSYDTGDKALQCGRHVDVFKLWLMWRAKGTTGFEAHVDKCLELAEYLYNIIKNREGYEMVFDGKPQHTNVCFWYIPPSLRTLEDNEERMSRLSKVAPVIKARMMEYGTTMVSYQPLGDKVNFFRMVISNPAATHQDIDFLIEEIERLGQDL

SEQ ID NO: 1842 - protein, 14 aa, Homo sapiens
AFIEFKADEKKEDE

SEQ ID NO: 1843 - protein, 15 aa, Homo sapiens
CFWYIPPSLRTLEDN

SEQ ID NO: 1844 - protein, 15 aa, Homo sapiens
ERMSRLSKVAPVIKA

SEQ ID NO: 1845 - protein, 18 aa, Bos taurus
FKADEKKFWGKYLYEIAR

SEQ ID NO: 1846 - protein, 33 aa, Homo sapiens
NMYAMMIARFKMFPEVKEKGMAALPRLIAFTSE

SEQ ID NO: 1847 - protein, 20 aa, Homo sapiens
SRLSKVAPVIKARMMEYGTT

SEQ ID NO: 1848 - protein, 41 aa, Homo sapiens
VSYQPLGDKVNFFRMVISNPAATHQDIDFLIEEIERLGQDL

SEQ ID NO: 1849 - protein, 20 aa, Homo sapiens
AEDEVQRERVSAKNALESYA

SEQ ID NO: 1850 - protein, 20 aa, Homo sapiens
AEKDEFEHKRKELEQVCNPI

SEQ ID NO: 1851 - protein, 20 aa, Homo sapiens
AGGVMTALIKRNSTIPTKQT

SEQ ID NO: 1852 - protein, 10 aa, Homo sapiens
AKSKNHTTHN

SEQ ID NO: 1853 - protein, 9 aa, Homo sapiens
ALTAVAEEV

SEQ ID NO: 1854 - protein, 12 aa, Homo sapiens
AQVATISANGDK

SEQ ID NO: 1855 - protein, 12 aa, Homo sapiens
AVADICKKYKIW

SEQ ID NO: 1856 - protein, 20 aa, Homo sapiens
DGVTVAKSIDLKDKYKNIGA

SEQ ID NO: 1857 - protein, 31 aa, Homo sapiens
DKVNFFRMVISNPAATHQDIDFLIEEIERLG

SEQ ID NO: 1858 - protein, 20 aa, Homo sapiens
DTERLIGDAAKNQVALNPQN

SEQ ID NO: 1859 - protein, 16 aa, Homo sapiens
EDLQVGQVELGGGPGA

SEQ ID NO: 1860 - protein, 20 aa, Mus musculus
EEIAQVATISANGDKDIGNI

SEQ ID NO: 1861 - protein, 20 aa, Homo sapiens
EEIAQVATISANGDKEIGNI

SEQ ID NO: 1862 - protein, 9 aa, Homo sapiens
FLQDVMNIL

SEQ ID NO: 1863 - protein, 16 aa, Homo sapiens
FYTPKTRREAEDLQVG

SEQ ID NO: 1864 - protein, 18 aa, Homo sapiens
GAGSLQPLALEGSLQKRG

SEQ ID NO: 1865 - protein, 20 aa, Homo sapiens
GLNVLRIINEPTAAAIAYGL

SEQ ID NO: 1866 - protein, 10 aa, Homo sapiens
GSGPTIEEVD

SEQ ID NO: 1867 - protein, 10 aa, Homo sapiens
HLCGSHLVEA

SEQ ID NO: 1868 - protein, 16 aa, Homo sapiens
HLVEALYLVCGERGFF

SEQ ID NO: 1869 - protein, 20 aa, Homo sapiens
IAYGLDRTGKGERNVLIFDL

SEQ ID NO: 1870 - protein, 15 aa, Homo sapiens
IDFLIEEIERLGQDL

SEQ ID NO: 1871 - protein, 20 aa, Homo sapiens
IPPSLRTLEDNEERMSRLSK

SEQ ID NO: 1872 - protein, 20 aa, Homo sapiens
KANKITITNDKGRLSKEEIE

SEQ ID NO: 1873 - protein, 20 aa, Homo sapiens
KAPGFGDNRKNQLKDMAIAT

SEQ ID NO: 1874 - protein, 20 aa, Homo sapiens
KEEIERMVQEAEKYKAEDEV

SEQ ID NO: 1875 - protein, 15 aa, Homo sapiens
KKGAAALGIGTDSVI

SEQ ID NO: 1876 - protein, 12 aa, Homo sapiens
KKYKIWMHVDAA

SEQ ID NO: 1877 - protein, 12 aa, Homo sapiens
KLCALLYGDAEK

SEQ ID NO: 1878 - protein, 20 aa, Homo sapiens
KRTLSSSTQASLEIDSLFEG

SEQ ID NO: 1879 - protein, 18 aa, Homo sapiens
KVNFFRMVISNPAATHQD

SEQ ID NO: 1880 - protein, 20 aa, Homo sapiens
LESYAFNMKSAVEDEGLKGK

SEQ ID NO: 1881 - protein, 15 aa, Homo sapiens
LKKMREIIGWPGGSG

SEQ ID NO: 1882 - protein, 20 aa, Homo sapiens
LLADAVAVTMGPKGRTVIIE

SEQ ID NO: 1883 - protein, 20 aa, Homo sapiens
LLLLDVAPLSLGLETAGGVM

SEQ ID NO: 1884 - protein, 9 aa, Homo sapiens
LLQEYNWEL

SEQ ID NO: 1885 - protein, 9 aa, Mus musculus
LYLVCGERG

SEQ ID NO: 1886 - protein, 20 aa, Homo sapiens
MAKAAAVGIDLGTTYSCVGV

SEQ ID NO: 1887 - protein, 12 aa, Homo sapiens
MASPGSGFWSFG

SEQ ID NO: 1888 - protein, 20 aa, Homo sapiens
MLRLPTVFRQMRPVSRVLAP

SEQ ID NO: 1889 - protein, 20 aa, Homo sapiens
NDQGNRTTPSYVAFTDTERL

SEQ ID NO: 1890 - protein, 20 aa, Homo sapiens
NEEAGDGTTTATVLARSIAK

SEQ ID NO: 1891 - protein, 14 aa, Homo sapiens
NILLQYVVKSFDRS

SEQ ID NO: 1892 - protein, 13 aa, Homo sapiens
NPAATHQDIDFLI

SEQ ID NO: 1893 - protein, 20 aa, Homo sapiens
NPVEIRRGVMLAVDAVIAEL

SEQ ID NO: 1894 - protein, 12 aa, Homo sapiens
PAESGGSQPPRA

SEQ ID NO: 1895 - protein, 20 aa, Homo sapiens
PAPGVPQIEVTFDIDANGIL

SEQ ID NO: 1896 - protein, 20 aa, Homo sapiens
PFQVINDGDKPKVQVSYKGE

SEQ ID NO: 1897 - protein, 20 aa, Homo sapiens
PGPGGFGAQGPKGGSGSGPT

SEQ ID NO: 1898 - protein, 20 aa, Homo sapiens
PTKQTQIFTTYSDNQPGVLI

SEQ ID NO: 1899 - protein, 13 aa, Unknown
  epitope involved in diabetes
PVQLSNQWHVVGA

SEQ ID NO: 1900 - protein, 20 aa, Homo sapiens
QDAYVLLSEKKISSIQSIVP

SEQ ID NO: 1901 - protein, 21 aa, Homo sapiens
QSIVPALEIANAHRKPLVIIA

SEQ ID NO: 1902 - protein, 20 aa, Homo sapiens
RFEELCSDLFRSTLEPVEKA

SEQ ID NO: 1903 - protein, 20 aa, Homo sapiens
RKGVITVKDGKTLNDELEII

SEQ ID NO: 1904 - protein, 10 aa, Homo sapiens
RMMEYGTTMV

SEQ ID NO: 1905 - protein, 20 aa, Homo sapiens
RSIAKEGFEKISKGANPVEI

SEQ ID NO: 1906 - protein, 20 aa, Homo sapiens
RVLAPHLTRAYAKDVKFGAD

SEQ ID NO: 1907 - protein, 20 aa, Homo sapiens
SCVGVFQHGKVEIIANDQGN

SEQ ID NO: 1908 - protein, 10 aa, Homo sapiens
SLYHVYEVNL

SEQ ID NO: 1909 - protein, 12 aa, Homo sapiens
TARAWCQVAQKF

SEQ ID NO: 1910 - protein, 20 aa, Homo sapiens
THLGGEDFDNRLVNHFVEEF

SEQ ID NO: 1911 - protein, 9 aa, Homo sapiens
TIADFWQMV

SEQ ID NO: 1912 - protein, 20 aa, Homo sapiens
TIDDGIFEVKATAGDTHLGG

SEQ ID NO: 1913 - protein, 20 aa, Homo sapiens
TVIIEQSWGSPKVTKDGVTV

SEQ ID NO: 1914 - protein, 10 aa, Homo sapiens
VCGERGFFYT

SEQ ID NO: 1915 - protein, 20 aa, Homo sapiens
VCNPIISGLYQGAGGPGPGG

SEQ ID NO: 1916 - protein, 20 aa, Homo sapiens
VDKCLELAEYLYNIIKNREG

SEQ ID NO: 1917 - protein, 13 aa, Homo sapiens
VEQCCTSICSLYQ

SEQ ID NO: 1918 - protein, 20 aa, Homo sapiens
VIAELKKQSKPVTTPEEIAQ

SEQ ID NO: 1919 - protein, 9 aa, Homo sapiens
VIVMLTPLV

SEQ ID NO: 1920 - protein, 24 aa, Unknown
  epitope involved in diabetes
VLGGGVLLLRVIPALDSLTPANED

SEQ ID NO: 1921 - protein, 10 aa, Homo sapiens
VMNILLQYVV

SEQ ID NO: 1922 - protein, 20 aa, Homo sapiens
VNMVEKGIIDPTKVVRTALL

SEQ ID NO: 1923 - protein, 20 aa, Homo sapiens
VQKLLQDFFNGRDLNKSINP

SEQ ID NO: 1924 - protein, 20 aa, Homo sapiens
VTDALNATRAAVEEGIVLGG

SEQ ID NO: 1925 - protein, 9 aa, Mus musculus
VYLKTNVFL

SEQ ID NO: 1926 - protein, 13 aa, Homo sapiens
AKGTTGFEAHVDK

SEQ ID NO: 1927 - protein, 10 aa, Homo sapiens
ALWGPDPAAA

SEQ ID NO: 1928 - protein, 15 aa, Homo sapiens
FDRSTKVIDFHYPNE

SEQ ID NO: 1929 - protein, 20 aa, Homo sapiens
FFRMVISNPAATHQDIDFLI

SEQ ID NO: 1930 - protein, 13 aa, Homo sapiens
FFYTPKTRREAED

SEQ ID NO: 1931 - protein, 17 aa, Homo sapiens
FYTPKTRREAEDLQVGQ

SEQ ID NO: 1932 - protein, 17 aa, Homo sapiens
GGPGAGSLQPLALEGSL

SEQ ID NO: 1933 - protein, 12 aa, Homo sapiens
GHPRYFNQLSTG

SEQ ID NO: 1934 - protein, 20 aa, Homo sapiens
IPPSLRYLEDNEERMSRLSK

SEQ ID NO: 1935 - protein, 20 aa, Mus musculus
KGDKAHIEKRIQEITEQLDI

SEQ ID NO: 1936 - protein, 15 aa, Homo sapiens
KHYDLSYDTGDKALQ

SEQ ID NO: 1937 - protein, 15 aa, Homo sapiens
KRGIVEQCCTSICSL

SEQ ID NO: 1938 - protein, 9 aa, Homo sapiens
LALEGSLQK

SEQ ID NO: 1939 - protein, 17 aa, Homo sapiens
LALWGPDPAAAFVNQHL

SEQ ID NO: 1940 - protein, 17 aa, Homo sapiens
LLPLLALLALWGPDPAA

SEQ ID NO: 1941 - protein, 9 aa, Homo sapiens
LNIDLLWSV

SEQ ID NO: 1942 - protein, 14 aa, Homo sapiens
LPRLIAFTSEHSHF

SEQ ID NO: 1943 - protein, 15 aa, Homo sapiens
LPRLIAFTSEHSHFS

SEQ ID NO: 1944 - protein, 17 aa, Homo sapiens
LVEALYLVCGERGFFYT

SEQ ID NO: 1945 - protein, 10 aa, Unknown
  epitope involved in diabetes
LWEIEFAKQL

SEQ ID NO: 1946 - protein, 16 aa, Homo sapiens
MALWMRLLPLLALLAL

SEQ ID NO: 1947 - protein, 20 aa, Homo sapiens
NWELADQPQNLEEILMHCQT

SEQ ID NO: 1948 - protein, 17 aa, Homo sapiens
PAAAFVNQHLCGSHLVE

SEQ ID NO: 1949 - protein, 14 aa, Homo sapiens
PGSGFWSFGSEDGS

SEQ ID NO: 1950 - protein, 17 aa, Homo sapiens
QHLCGSHLVEALYLVCG

SEQ ID NO: 1951 - protein, 17 aa, Homo sapiens
REAEDLQVGQVELGGGP

SEQ ID NO: 1952 - protein, 12 aa, Homo sapiens
RLIAFTSEHSHF

SEQ ID NO: 1953 - protein, 9 aa, Homo sapiens
RLLPLLALL

SEQ ID NO: 1954 - protein, 15 aa, Homo sapiens
RMMEYGTTMVSYQPL

SEQ ID NO: 1955 - protein, 20 aa, Mus musculus
RTALLDAAGVASLLTTAEAV

SEQ ID NO: 1956 - protein, 20 aa, Mus musculus
TAEAVVTEIPKEEKDPGMGA

SEQ ID NO: 1957 - protein, 20 aa, Homo sapiens [sequence omitted]

SEQ ID NO: 1958 - protein, 17 aa, Homo sapiens
VCGERGFFYTPKTRREA

SEQ ID NO: 1959 - protein, 17 aa, Homo sapiens
VGQVELGGGPGAGSLQP

SEQ ID NO: 1960 - protein, 9 aa, Homo sapiens
VLFGLGFAI

SEQ ID NO: 1961 - protein, 24 aa, Homo sapiens
VLGGGCALLRCIPALDSLTPANED

SEQ ID NO: 1962 - protein, 8 aa, Homo sapiens
WGPDPAAA

SEQ ID NO: 1963 - protein, 582 aa, Homo sapiens
PGSGFWSFGSEDGSGDSENPGTARAWCQVAQKFTGGIGNKLCALLYGDAEKPAESGGSQPPRAAARKAACACDQKPCSCSKVDVNYAFLHATDLLPACDGERPTLAFLQDVMNILLQYVVKSFDRSTKVIDFHYPNELLQEYNWELADQPQNLEEILMHCQTTLKYAIKTGHPRYFNQLSTGLDMVGLAADWLTSTANTNMFTYEIAPVFVLLEYVTLKKMREIIGWPGGSGDGIFSPGGAISNMYAMMIARFKMFPEVKEKGMAALPRLIAFTSEHSHFSLKKGAAALGIGTDSVILIKCDERGKMIPSDLERRILEAKQKGFVPFLVSATAGTTVYGAFDPLLAVADICKKYKIWMHVDAAWGGGLLMSRKHKWKLSGVERANSVTWNPHKMMGVPLQCSALLVREEGLMQNCNQMHASYLFQQDKHYDLSYDTGDKALQCGRHVDVFKLWLMWRAKGTTGFEAHVDKCLELAEYLYNIIKNREGYEMVFDGKPQHTNVCFWYIPPSLRTLEDNEERMSRLSKVAPVIKARMMEYGTTMVSYQPLGDKVNFFRMVISNPAATHQDIDFLIEEIERLGQDL

SEQ ID NO: 1964 - protein, 11 aa, Homo sapiens
AFTSEHSHFSL

SEQ ID NO: 1965 - protein, 12 aa, Homo sapiens
AFTSEHSHFSLK

SEQ ID NO: 1966 - protein, 17 aa, Homo sapiens
AGSLQPLALEGSLQKRG

SEQ ID NO: 1967 - protein, 9 aa, Homo sapiens
ALYLVCGER

SEQ ID NO: 1968 - protein, 18 aa, Homo sapiens
ANTNMFTYEIAPVFVLLE

SEQ ID NO: 1969 - protein, 20 aa, Homo sapiens
ATHQDIDFLIEEIERLGQDL

SEQ ID NO: 1970 - protein, 9 aa, Unknown
  epitope involved in diabetes
AYNKANWFL

SEQ ID NO: 1971 - protein, 16 aa, Homo sapiens
CCTSICSLYQLENYCN

SEQ ID NO: 1972 - protein, 11 aa, Unknown
  epitope involved in diabetes
CHAVKVGNPSC

SEQ ID NO: 1973 - protein, 11 aa, Unknown
  epitope involved in diabetes
CPRDLNGKSGC

SEQ ID NO: 1974 - protein, 20 aa, Homo sapiens
EAKQKGFVPFLVSATAGTTV

SEQ ID NO: 1975 - protein, 20 aa, Homo sapiens
ERMSRLSKVAPVIKARMMEY

SEQ ID NO: 1976 - protein, 20 aa, Homo sapiens
EVKEKGMAALPRLIAFTSEH

SEQ ID NO: 1977 - protein, 11 aa, Homo sapiens
FKMFPEVKEKG

SEQ ID NO: 1978 - protein, 10 aa, Homo sapiens
FTSEHSHFSL

SEQ ID NO: 1979 - protein, 17 aa, Homo sapiens
FVNQHLCGSHLVEALYL

SEQ ID NO: 1980 - protein, 13 aa, Homo sapiens
FWYIPPSLRTLED

SEQ ID NO: 1981 - protein, 20 aa, Homo sapiens
GDKVNFFRMVISNPAATHQD

SEQ ID NO: 1982 - protein, 17 aa, Homo sapiens
GERGFFYTPKTRREAED

SEQ ID NO: 1983 - protein, 21 aa, Homo sapiens
GGGLLMSRKHKWKLSGVERAN

SEQ ID NO: 1984 - protein, 15 aa, Homo sapiens
GIVEQCCTSICSLYQ

SEQ ID NO: 1985 - protein, 19 aa, Homo sapiens
GLMQNCNQMHASYLFQQDK

SEQ ID NO: 1986 - protein, 17 aa, Homo sapiens
GQVELGGGPGAGSLQPL

SEQ ID NO: 1987 - protein, 15 aa, Homo sapiens
GSHLVEALYLVCGER

SEQ ID NO: 1988 - protein, 17 aa, Homo sapiens
GSLQKRGIVEQCCTSIC

SEQ ID NO: 1989 - protein, 20 aa, Homo sapiens
GTTMVSYQPLGDKVNFFRMV

SEQ ID NO: 1990 - protein, 15 aa, Homo sapiens
HLCGSHLVEALYLVC

SEQ ID NO: 1991 - protein, 15 aa, Homo sapiens
HLVEALYLVCGERGF

SEQ ID NO: 1992 - protein, 20 aa, Homo sapiens
HTNVCFWYIPPSLRTLEDNE

SEQ ID NO: 1993 - protein, 14 aa, Unknown
  epitope involved in diabetes
IMEQCFEIGCPATN

SEQ ID NO: 1994 - protein, 16 aa, Homo sapiens
IPPSLRTLEDNEERMS

SEQ ID NO: 1995 - protein, 20 aa, Homo sapiens
ISNPAATHQDIDFLIEEIER

SEQ ID NO: 1996 - protein, 9 aa, Unknown
  epitope involved in diabetes
KYNKAAWFL

SEQ ID NO: 1997 - protein, 9 aa, Unknown
  epitope involved in diabetes
KYNKANAFL

SEQ ID NO: 1998 - protein, 9 aa, Unknown
  epitope involved in diabetes
KYNKANWAL

SEQ ID NO: 1999 - protein, 9 aa, Unknown
  epitope involved in diabetes
KYNKANWFL

SEQ ID NO: 2000 - protein, 17 aa, Homo sapiens
LCGSHLVEALYLVCGER

SEQ ID NO: 2001 - protein, 14 aa, Unknown
  epitope involved in diabetes
LMEPCYAWGCTGPK

SEQ ID NO: 2002 - protein, 15 aa, Homo sapiens
LVEALYLVCGERGFF

SEQ ID NO: 2003 - protein, 15 aa, Homo sapiens
LYLVCGERGFFYTPK

SEQ ID NO: 2004 - protein, 15 aa, Homo sapiens
MIARFKMFPEVKEKG

SEQ ID NO: 2005 - protein, 20 aa, Homo sapiens
MMIARFKMFPEVKEKGMAAL

SEQ ID NO: 2006 - protein, 10 aa, Homo sapiens
MYAMMIARFK

SEQ ID NO: 2007 - protein, 12 aa, Homo sapiens
MYAMMIARFKMF

SEQ ID NO: 2008 - protein, 14 aa, Unknown
  epitope involved in diabetes
NDSQCWKLGCIAEK

SEQ ID NO: 2009 - protein, 12 aa, Homo sapiens
NILLQYVVKSFD

SEQ ID NO: 2010 - protein, 14 aa, Unknown
  epitope involved in diabetes
NPEDCFKTGCNSPT

SEQ ID NO: 2011 - protein, 12 aa, Homo sapiens
NYAFLHATDLLP

SEQ ID NO: 2012 - protein, 20 aa, Homo sapiens
PSLRTLEDNEERMSRLSKVA

SEQ ID NO: 2013 - protein, 20 aa, Homo sapiens
PVIKARMMEYGTTMVSYQPL

SEQ ID NO: 2014 - protein, 15 aa, Homo sapiens
QHLCGSHLVEALYLV

SEQ ID NO: 2015 - protein, 9 aa, Homo sapiens
RFKMFPEVK

SEQ ID NO: 2016 - protein, 10 aa, Homo sapiens
RFKMFPEVKE

SEQ ID NO: 2017 - protein, 11 aa, Homo sapiens
RFKMFPEVKEK

SEQ ID NO: 2018 - protein, 10 aa, Homo sapiens
SHLVEALYLV

SEQ ID NO: 2019 - protein, 14 aa, Unknown
  epitope involved in diabetes
SNVECDGLNCDWII

SEQ ID NO: 2020 - protein, 16 aa, Homo sapiens
SPSLWEIEFAKQLASV

SEQ ID NO: 2021 - protein, 16 aa, Unknown
  epitope involved in diabetes
SPSLWEIEIAKQLASV

SEQ ID NO: 2022 - protein, 17 aa, Homo sapiens
TRREAEDLQVGQVELGG

SEQ ID NO: 2023 - protein, 9 aa, Homo sapiens
TSEHSHFSL

SEQ ID NO: 2024 - protein, 15 aa, Homo sapiens
VEALYLVCGERGFFY

SEQ ID NO: 2025 - protein, 9 aa, Homo sapiens
VMNILLQYV

SEQ ID NO: 2026 - protein, 20 aa, Homo sapiens
YEMVFDGKPQHTNVCFWYIP

SEQ ID NO: 2027 - protein, 15 aa, Homo sapiens
YLVCGERGFFYTPKT

SEQ ID NO: 2028 - protein, 979 aa, Homo sapiens
MRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQKPLSLAAGVKLLEILAEHVHMSSGSFINISVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 2029 - protein, 20 aa, Homo sapiens
AALGIGTDSVILIKCDERGK

SEQ ID NO: 2030 - protein, 12 aa, Homo sapiens
AFIKATGKKEDE

SEQ ID NO: 2031 - protein, 11 aa, Mus musculus
APVIKARMMEY

SEQ ID NO: 2032 - protein, 13 aa, Homo sapiens
CAYQAEPNTCATA

SEQ ID NO: 2033 - protein, 13 aa, Homo sapiens
CTVIVMLTPLVED

SEQ ID NO: 2034 - protein, 13 aa, Homo sapiens
DQFEFALTAVAEE

SEQ ID NO: 2035 - protein, 15 aa, Unknown
  epitope involved in diabetes
EKAHRPIWARMDAKK

SEQ ID NO: 2036 - protein, 20 aa, Homo sapiens
EYVTLKKMREIIGWPGGSGD

SEQ ID NO: 2037 - protein, 15 aa, Bos taurus
FKADEKKFWGKYLYE

SEQ ID NO: 2038 - protein, 19 aa, Homo sapiens
FYLKNVQTQETRTLTQFHF

SEQ ID NO: 2039 - protein, 20 aa, Homo sapiens
GMAALPRLIAFTSEHSHFSL

SEQ ID NO: 2040 - protein, 13 aa, Homo sapiens
GSFINISVVGPAL

SEQ ID NO: 2041 - protein, 18 aa, Homo sapiens
GSLQPLALEGSLQKRGIV

SEQ ID NO: 2042 - protein, 20 aa, Mus musculus
HTPGVHMASLSVYLKTNVFL

SEQ ID NO: 2043 - protein, 15 aa, Homo sapiens
IKARMMEYGTTMVSY

SEQ ID NO: 2044 - protein, 20 aa, Homo sapiens
IKLKVESSPSRSDYINASPI

SEQ ID NO: 2045 - protein, 9 aa, Unknown
  epitope involved in diabetes
KYNKANVFL

SEQ ID NO: 2046 - protein, 23 aa, Homo sapiens
LAKEWQALCAYQAEPNTCATAQG

SEQ ID NO: 2047 - protein, 15 aa, Homo sapiens
LAKLSDGVAVLKVGG

SEQ ID NO: 2048 - protein, 13 aa, Homo sapiens
LEILAEHVHMSSG

SEQ ID NO: 2049 - protein, 19 aa, Mus musculus
LHRSGVLIIHHLQEDYRTY

SEQ ID NO: 2050 - protein, 20 aa, Homo sapiens
LYHVYEVNLVSEHIWCEDFL

SEQ ID NO: 2051 - protein, 17 aa, Homo sapiens
MASPGSGFWSFGSEDGS

SEQ ID NO: 2052 - protein, 37 aa, Homo sapiens
MGILKLQVFLIVLSVALNHLKATPIESHQVEKRKCNT

SEQ ID NO: 2053 - protein, 15 aa, Homo sapiens
MVFDGKPQHTNVCFW

SEQ ID NO: 2054 - protein, 21 aa, Homo sapiens
MVWESGCTVIVMLTPLVEDGV

SEQ ID NO: 2055 - protein, 9 aa, Unknown
  epitope involved in diabetes
NRVAPNVRQ

SEQ ID NO: 2056 - protein, 13 aa, Homo sapiens
PAYIATQGPLSHT

SEQ ID NO: 2057 - protein, 15 aa, Mus musculus
PHLVEALYLVCGERG

SEQ ID NO: 2058 - protein, 13 aa, Homo sapiens
PSLSYEPALLQPY

SEQ ID NO: 2059 - protein, 15 aa, Mus musculus
PVIKARMMEYGTTMV

SEQ ID NO: 2060 - protein, 13 aa, Homo sapiens
RSVLLTLVALAGV

SEQ ID NO: 2061 - protein, 20 aa, Homo sapiens
SEHIWCEDFLVRSFYLKNVQ

SEQ ID NO: 2062 - protein, 15 aa, Mus musculus
SHLVEALYLVAGERG

SEQ ID NO: 2063 - protein, 21 aa, Homo sapiens
SKDQFEFALTAVAEEVNAILK

SEQ ID NO: 2064 - protein, 13 aa, Homo sapiens
SLYHVYEVNLVSE

SEQ ID NO: 2065 - protein, 10 aa, Mus musculus
SLYQLENYCN

SEQ ID NO: 2066 - protein, 18 aa, Mus musculus
TAALSYTISRMEESSVTL

SEQ ID NO: 2067 - protein, 15 aa, Homo sapiens
TGHPRYFNQLSTGLD

SEQ ID NO: 2068 - protein, 13 aa, Mus musculus
TQYEAVATSNMQE

SEQ ID NO: 2069 - protein, 13 aa, Homo sapiens
TYILIDMVLNRMA

SEQ ID NO: 2070 - protein, 16 aa, Mus musculus
VPPSLRTLEDNEERMS

SEQ ID NO: 2071 - protein, 16 aa, Mus musculus
VPTSLRRLEQPNVAIS

SEQ ID NO: 2072 - protein, 18 aa, Homo sapiens
VSSQFSDAAQASPSSHSS

SEQ ID NO: 2073 - protein, 23 aa, Mus musculus
WYVMVTAALSYTISRMEESSVTL

SEQ ID NO: 2074 - protein, 979 aa, Homo sapiens; identical to SEQ ID NO: 2028

SEQ ID NO: 2075 - protein, 11 aa, Unknown
  epitope involved in diabetes
AVRPLWVRMEA

SEQ ID NO: 2076 - protein, 10 aa, Homo sapiens
DTTFEYQDLC

SEQ ID NO: 2077 - protein, 11 aa, Mus musculus
EALYLVCGERG

SEQ ID NO: 2078 - protein, 9 aa, Homo sapiens
ELAEYLYNI

SEQ ID NO: 2079 - protein, 10 aa, Homo sapiens
GAHGDTTFEY

SEQ ID NO: 2080 - protein, 7 aa, Unknown
  epitope involved in diabetes
GERAKRS

SEQ ID NO: 2081 - protein, 12 aa, Bos taurus
GIVEQCCASVCS

SEQ ID NO: 2082 - protein, 15 aa, Bos taurus
GIVEQCCASVCSLYQ

SEQ ID NO: 2083 - protein, 12 aa, Homo sapiens
GIVEQCCTSICS

SEQ ID NO: 2084 - protein, 23 aa, Mus musculus
GRHSAEYYNKQYLERTRAELDTA

SEQ ID NO: 2085 - protein, 9 aa, Homo sapiens
ILMHCQTTL

SEQ ID NO: 2086 - protein, 7 aa, Unknown
  epitope involved in diabetes
LDQRSSK

SEQ ID NO: 2087 - protein, 7 aa, Unknown
  epitope involved in diabetes
LDQSRLK

SEQ ID NO: 2088 - protein, 19 aa, Mus musculus
LKICGFLQRTNSLEEKSRL

SEQ ID NO: 2089 - protein, 7 aa, Unknown
  epitope involved in diabetes
LPGERQI

SEQ ID NO: 2090 - protein, 7 aa, Unknown
  epitope involved in diabetes
LPNRSQI

SEQ ID NO: 2091 - protein, 7 aa, Unknown
  epitope involved in diabetes
NIKSSLP

SEQ ID NO: 2092 - protein, 7 aa, Unknown
  epitope involved in diabetes
NPGSSLG

SEQ ID NO: 2093 - protein, 17 aa, Mus musculus
NSQPEILERTRAEVDTA

SEQ ID NO: 2094 - protein, 7 aa, Unknown
  epitope involved in diabetes
PDGSRLV

SEQ ID NO: 2095 - protein, 7 aa, Unknown
  epitope involved in diabetes
PGSRLQP

SEQ ID NO: 2096 - protein, 7 aa, Unknown
  epitope involved in diabetes
PGTRLQP

SEQ ID NO: 2097 - protein, 7 aa, Unknown
  epitope involved in diabetes
PSRLVNQ

SEQ ID NO: 2098 - protein, 12 aa, Bos taurus
QCCASVCSLYQL

SEQ ID NO: 2099 - protein, 12 aa, Homo sapiens
QCCTSICSLYQL

SEQ ID NO: 2100 - protein, 7 aa, Unknown
  epitope involved in diabetes
QGERSGP

SEQ ID NO: 2101 - protein, 7 aa, Unknown
  epitope involved in diabetes
QRSGRGP

SEQ ID NO: 2102 - protein, 15 aa, Unknown
  epitope involved in diabetes
SHLVEALALVAGERG

SEQ ID NO: 2103 - protein, 8 aa, Mus musculus
SHLVEALY

SEQ ID NO: 2104 - protein, 7 aa, Unknown
  epitope involved in diabetes
STGERIQ

SEQ ID NO: 2105 - protein, 20 aa, Homo sapiens
TNMFTYEIAPVFVLLEYVTL

SEQ ID NO: 2106 - protein, 13 aa, Bos taurus
VCGERGFFYTPKA

SEQ ID NO: 2107 - protein, 7 aa, Unknown
  epitope involved in diabetes
VGERGSK

SEQ ID NO: 2108 - protein, 7 aa, Unknown
  epitope involved in diabetes
VIQGSQL

SEQ ID NO: 2109 - protein, 7 aa, Unknown
  epitope involved in diabetes
VIQGSRL

SEQ ID NO: 2110 - protein, 24 aa, Mus musculus
VLGGGCALLRCIPALDSLKPANED

SEQ ID NO: 2111 - protein, 7 aa, Unknown
  epitope involved in diabetes
VPQQSIP

SEQ ID NO: 2112 - protein, 7 aa, Unknown
  epitope involved in diabetes
VRGRGSK

SEQ ID NO: 2113 - protein, 7 aa, Unknown
  epitope involved in diabetes
VSRSLLD

SEQ ID NO: 2114 - protein, 585 aa, Homo sapiens; identical to SEQ ID NO: 1841

SEQ ID NO: 2115 - protein, 30 aa, Homo sapiens
AAAFVNQHLCGSHLVEALYLVCGERGFFYT

SEQ ID NO: 2116 - protein, 9 aa, Mus musculus
ALIPYCVHM

SEQ ID NO: 2117 - protein, 9 aa, Mus musculus
ALSYTISRM

SEQ ID NO: 2118 - protein, 9 aa, Mus musculus
ATHFPHQVI

SEQ ID NO: 2119 - protein, 9 aa, Mus musculus
CALTSLTTM

SEQ ID NO: 2120 - protein, 9 aa, Mus musculus
CANPDWIHI

SEQ ID NO: 2121 - protein, 21 aa, Homo sapiens
CGRHVDVFKLWLMWRAKGTTG

SEQ ID NO: 2122 - protein, 9 aa, Mus musculus
CKSASIPLM

SEQ ID NO: 2123 - protein, 9 aa, Mus musculus
CQGENGTKP

SEQ ID NO: 2124 - protein, 20 aa, Homo sapiens
DERGKMIPSDLERRILEAKQ

SEQ ID NO: 2125 - protein, 9 aa, Mus musculus
DFLHRSGVL

SEQ ID NO: 2126 - protein, 12 aa, Unknown
  epitope involved in diabetes
DSYEIMQGRAVV

SEQ ID NO: 2127 - protein, 9 aa, Mus musculus
DYRTYYGFL

SEQ ID NO: 2128 - protein, 20 aa, Homo sapiens
EEILMHCQTTLKYAIKTGHP

SEQ ID NO: 2129 - protein, 20 aa, Homo sapiens
ERANSVTWNPHKMMGVPLQC

SEQ ID NO: 2130 - protein, 9 aa, Mus musculus
ESSVTLHRL

SEQ ID NO: 2131 - protein, 20 aa, Homo sapiens
EYGTTMVSYQPLGDKVNFFR

SEQ ID NO: 2132 - protein, 20 aa, Homo sapiens
EYLYNIIKNREGYEMVFDGK

SEQ ID NO: 2133 - protein, 9 aa, Mus musculus
FAINSEMFL

SEQ ID NO: 2134 - protein, 9 aa, Mus musculus
FEHTPGVHM

SEQ ID NO: 2135 - protein, 9 aa, Mus musculus
FGIDLLWSV

SEQ ID NO: 2136 - protein, 9 aa, Mus musculus
FLHRSGVLI

SEQ ID NO: 2137 - protein, 9 aa, Homo sapiens
FLWSVFWLI

SEQ ID NO: 2138 - protein, 9 aa, Mus musculus
GDPRNIFSI

SEQ ID NO: 2139 - protein, 9 aa, Mus musculus
GFAINSEMF

SEQ ID NO: 2140 - protein, 20 aa, Homo sapiens
GGSGDGIFSPGGAISNMYAM

SEQ ID NO: 2141 - protein, 9 aa, Mus musculus
GHAMGSSCV

SEQ ID NO: 2142 - protein, 9 aa, Mus musculus
GLVRNLGVL

SEQ ID NO: 2143 - protein, 9 aa, Mus musculus
GTKPSFRLL

SEQ ID NO: 2144 - protein, 9 aa, Mus musculus
HAEPLFYLL

SEQ ID NO: 2145 - protein, 9 aa, Mus musculus
HMASLSVYL

SEQ ID NO: 2146 - protein, 9 aa, Mus musculus
IYFPLWFQL

SEQ ID NO: 2147 - protein, 9 aa, Mus musculus
IYPNHSSPC

SEQ ID NO: 2148 - protein, 22 aa, Homo sapiens
KGTTGFEAHVDKCLELAEYLYN

SEQ ID NO: 2149 - protein, 9 aa, Mus musculus
KIPTHAEPL

SEQ ID NO: 2150 - protein, 20 aa, Homo sapiens
KTGHPRYFNQLSTGLDMVGL

SEQ ID NO: 2151 - protein, 9 aa, Mus musculus
KWCANPDWI

SEQ ID NO: 2152 - protein, 22 aa, Homo sapiens
LAFLQDVMNILLQYVVKSFDRS

SEQ ID NO: 2153 - protein, 20 aa, Homo sapiens
LEAKQKGFVPFLVSATAGTT

SEQ ID NO: 2154 - protein, 9 aa, Mus musculus
LGFAINSEM

SEQ ID NO: 2155 - protein, 20 aa, Homo sapiens
LLYGDAEKPAESGGSQPPRA

SEQ ID NO: 2156 - protein, 9 aa, Mus musculus
LRLFGIDLL

SEQ ID NO: 2157 - protein, 9 aa, Mus musculus
LSFCKSASI

SEQ ID NO: 2158 - protein, 9 aa, Mus musculus
LSVYLKTNV

SEQ ID NO: 2159 - protein, 9 aa, Mus musculus
LTSLTTMQL

SEQ ID NO: 2160 - protein, 9 aa, Mus musculus
MQLYRFIKI

SEQ ID NO: 2161 - protein, 11 aa, Unknown
  epitope involved in diabetes
MYELLQPAAIV

SEQ ID NO: 2162 - protein, 9 aa, Homo sapiens
NLFLFLFAV

SEQ ID NO: 2163 - protein, 9 aa, Mus musculus
NQNVGTKMI

SEQ ID NO: 2164 - protein, 20 aa, Homo sapiens
PEVKEKGMAALPRLIAFTSE

SEQ ID NO: 2165 - protein, 14 aa, Mus musculus
PSLWEIEFAKQLAS

SEQ ID NO: 2166 - protein, 9 aa, Mus musculus
QLNQNVGTK

SEQ ID NO: 2167 - protein, 20 aa, Homo sapiens
QNCNQMHASYLFQQDKHYDL

SEQ ID NO: 2168 - protein, 9 aa, Mus musculus
RFIKIPTHA

SEQ ID NO: 2169 - protein, 9 aa, Mus musculus
RMEESSVTL

SEQ ID NO: 2170 - protein, 9 aa, Mus musculus
SFCKSASIP

SEQ ID NO: 2171 - protein, 9 aa, Mus musculus
SFLWSVFWL

SEQ ID NO: 2172 - protein, 9 aa, Mus musculus
SRMEESSVT

SEQ ID NO: 2173 - protein, 9 aa, Mus musculus
SRVFIATHF

SEQ ID NO: 2174 - protein, 9 aa, Mus musculus
THAEPLFYL

SEQ ID NO: 2175 - protein, 9 aa, Mus musculus
THFPHQVIL

SEQ ID NO: 2176 - protein, 9 aa, Mus musculus
TSLTTMQLY

SEQ ID NO: 2177 - protein, 9 aa, Mus musculus
TYYGFLNFM

SEQ ID NO: 2178 - protein, 30 aa, Homo sapiens
VCGERGFFYTPKTRREAEDLQVGQVELGGG

SEQ ID NO: 2179 - protein, 9 aa, Mus musculus
VFWLIQISV

SEQ ID NO: 2180 - protein, 9 aa, Mus musculus
YLKTNVFLF

SEQ ID NO: 2181 - protein, 9 aa, Homo sapiens
YLLLRVLNI

SEQ ID NO: 2182 - protein, 9 aa, Mus musculus
YPNHSSPCL

SEQ ID NO: 2183 - protein, 9 aa, Mus musculus
YTISRMEES

SEQ ID NO: 2184 - protein, 10 aa, Unknown
  epitope involved in diabetes
YVRPLWVRME

SEQ ID NO: 2185 - protein, 10 aa, Homo sapiens
ALWMRLLPLL

SEQ ID NO: 2186 - protein, 13 aa, Homo sapiens
DWIHIDTTPFAGL

SEQ ID NO: 2187 - protein, 13 aa, Homo sapiens
EWVHIDTTPFASL

SEQ ID NO: 2188 - protein, 9 aa, Homo sapiens
FYTPKTRRE

SEQ ID NO: 2189 - protein, 8 aa, Homo sapiens
GERGFFYT

SEQ ID NO: 2190 - protein, 9 aa, Homo sapiens
LPLLALLAL

SEQ ID NO: 2191 - protein, 9 aa, Homo sapiens
LWMRLLPLL

SEQ ID NO: 2192 - protein, 5 aa, Homo sapiens
PAEGT

SEQ ID NO: 2193 - protein, 13 aa, Homo sapiens
QHLQKDYRAYYTF

SEQ ID NO: 2194 - protein, 13 aa, Homo sapiens
RVLNIDLLWSVPI

SEQ ID NO: 2195 - protein, 31 aa, Homo sapiens
WCEDFLVRSFYLKNVQTQETRTLTQFHFLSW

SEQ ID NO: 2196 - protein, 10 aa, Homo sapiens
WMRLLPLLAL

SEQ ID NO: 2197 - protein, 13 aa, Homo sapiens
YTFLNFMSNVGDP

SEQ ID NO: 2198 - protein, 979 aa, Homo sapiens; identical to SEQ ID NO: 2028

SEQ ID NO: 2199 - protein, 15 aa, Mus musculus
AELNQLRAKEPTKLA

SEQ ID NO: 2200 - protein, 15 aa, Mus musculus
ELRELRLRLDQLTAN

SEQ ID NO: 2201 - protein, 9 aa, Homo sapiens
ERGFFYTPK

SEQ ID NO: 2202 - protein, 7 aa, Mus musculus
GLAPSGA

SEQ ID NO: 2203 - protein, 10 aa, Homo sapiens
LCGSHLVEAL

SEQ ID NO: 2204 - protein, 10 aa, Homo sapiens
LVCGERGFFY

SEQ ID NO: 2205 - protein, 10 aa, Homo sapiens
LYLVCGERGF

SEQ ID NO: 2206 - protein, 15 aa, Mus musculus
QVHVEMDVAKPDLTA

SEQ ID NO: 2207 - protein, 9 aa, Mus musculus
WYRSKFADL

SEQ ID NO: 2208 - protein, 13 aa, Bos taurus
FKADEKKFWGKYL

SEQ ID NO: 2209 - protein, 9 aa, Homo sapiens
QMRPVSRVL

SEQ ID NO: 2210 - protein, 5 aa, Bos taurus
ADEKK

SEQ ID NO: 2211 - protein, 16 aa, Bos taurus
ADEKKFWGKYLYEIAR

SEQ ID NO: 2212 - protein, 5 aa, Bos taurus
EFKAD

SEQ ID NO: 2213 - protein, 6 aa, Bos taurus
EFKADE

SEQ ID NO: 2214 - protein, 8 aa, Bos taurus
EFKADEKK

SEQ ID NO: 2215 - protein, 6 aa, Bos taurus
FKADEK

SEQ ID NO: 2216 - protein, 9 aa, Simian immunodeficiency virus
FYCKMNWFL

SEQ ID NO: 2217 - protein, 9 aa, Aquifex aeolicus
GFIKNFWFI

SEQ ID NO: 2218 - protein, 9 aa, Helicobacter pylori
GYNKAMGFL

SEQ ID NO: 2219 - protein, 9 aa, Helicobacter pylori
IFFKTSSFL

SEQ ID NO: 2220 - protein, 9 aa, Saccharomyces cerevisiae
IYQKANTFL

SEQ ID NO: 2221 - protein, 9 aa, Helicobacter pylori
IYVKTSSFL

SEQ ID NO: 2222 - protein, 6 aa, Bos taurus
KADEKK

SEQ ID NO: 2223 - protein, 9 aa, Borrelia burgdorferi
KYNKNGNFL

SEQ ID NO: 2224 - protein, 9 aa, Haemophilus influenzae
KYYKNSQFL

SEQ ID NO: 2225 - protein, 9 aa, Saccharomyces cerevisiae
KYYKTSNFL

SEQ ID NO: 2226 - protein, 18 aa, Bos taurus
LPKLKPDPNTLCDEFKAD

SEQ ID NO: 2227 - protein, 9 aa, Borrelia burgdorferi 6
LYSKNLVFL

SEQ ID NO: 2228 - protein, 9 aa, Methanothermobacter thermautotrophicus
NFMKTAGFI

SEQ ID NO: 2229 - protein, 9 aa, Rickettsia prowazekii
QYNKTGYFI

SEQ ID NO: 2230 - protein, 9 aa, Langat virus
RFSKALYFL

SEQ ID NO: 2231 - protein, 9 aa, Escherichia coli
RYQKAGVML

SEQ ID NO: 2232 - protein, 9 aa, Aquifex aeolicus
TYLKNAQFV

SEQ ID NO: 2233 - protein, 9 aa, Drosophila melanogaster
VYVKTSSFI

SEQ ID NO: 2234 - protein, 9 aa, Haemophilus influenzae
YFLKCGYFL

SEQ ID NO: 2235 - protein, 9 aa, Sonchus yellow net virus
YYNKALSFI

SEQ ID NO: 2236 - protein, 21 aa, Homo sapiens
HGDTTFEYQDLCRQHMATKSL

SEQ ID NO: 2237 - protein, 21 aa, Homo sapiens
RLAALGPEGAHGDTTFEYQDL

SEQ ID NO: 2238 - protein, 20 aa, Homo sapiens
RQHARQQDKERLAALGPEGA

SEQ ID NO: 2239 - protein, 42 aa, Homo sapiens
RQHARQQDKERLAALGPEGAHGDTTFEYQDLCRQHMATKSLF

SEQ ID NO: 2240 - protein, 16 aa, Mus musculus
QCCTSICSLYQLENYC

SEQ ID NO: 2241 - protein, 12 aa, Bos taurus
EDKGACLLPKIE

SEQ ID NO: 2242 - protein, 30 aa, Homo sapiens
FFRMVISNPAATHQDIDFLIEEIERLGQDL

SEQ ID NO: 2243 - protein, 41 aa, Homo sapiens
GGAISNMYAMMIARFKMFPEVKEKGMAALPRLIAFTSEHSH

SEQ ID NO: 2244 - protein, 9 aa, Unknown
  epitope involved in diabetes
LYLVCGERL

SEQ ID NO: 2245 - protein, 17 aa, Homo sapiens
NIIKNREGYEMVFDGKP

SEQ ID NO: 2246 - protein, 4 aa, Homo sapiens
PGGS

SEQ ID NO: 2247 - protein, 9 aa, Homo sapiens
VIKARMMEY

SEQ ID NO: 2248 - protein, 9 aa, Unknown
  epitope involved in diabetes
YAIENYLEL

SEQ ID NO: 2249 - protein, 585 aa, Homo sapiens; identical to SEQ ID NO: 1841

SEQ ID NO: 2250 - protein, 12 aa, Mus musculus
LYFCAARSNYQL

SEQ ID NO: 2251 - protein, 15 aa, Homo sapiens
AYVLLSEKKISSIQS

SEQ ID NO: 2252 - protein, 15 aa, Homo sapiens
GEALSTLVLNRLKVG

SEQ ID NO: 2253 - protein, 15 aa, Mycobacterium
GEALSTLVVNKIRGT

SEQ ID NO: 2254 - protein, 11 aa, Homo sapiens
ALWGPDPAAAF

SEQ ID NO: 2255 - protein, 10 aa, Homo sapiens
LALWGPDPAA

SEQ ID NO: 2256 - protein, 11 aa, Homo sapiens
RLLPLLALLAL

SEQ ID NO: 2257 - protein, 42 aa, Homo sapiens
IAATLEHVRDQRPGLVRSKDQFEFALTAVAEEVNAILKALPQ

SEQ ID NO: 2258 - protein, 9 aa, Homo sapiens
NLAQDLATV

SEQ ID NO: 2259 - protein, 9 aa, Homo sapiens
QLARQQVHV

SEQ ID NO: 2260 - protein, 979 aa, Homo sapiens; identical to SEQ ID NO: 2028

SEQ ID NO: 2261 - protein, 12 aa, Human coxsackievirus
EWLKVKILPEVK

SEQ ID NO: 2262 - protein, 20 aa, Enterovirus A
WLKVKILPEVKEKHEFLNRL

SEQ ID NO: 2263 - protein, 15 aa, Human Endogenous Retrovirus
GKTCPKEIPKGSKNT

SEQ ID NO: 2264 - protein, 23 aa, Homo sapiens
ARFKMFPEVKEKGMAALPRLIAF

SEQ ID NO: 2265 - protein, 23 aa, Human coxsackievirus
LKVKILPEVKEKHEFLSRLKQLP

SEQ ID NO: 2266 - protein, 10 aa, Unknown
  epitope involved in diabetes
SLYQLENYCA

SEQ ID NO: 2267 - protein, 13 aa, Mus musculus
YKMFPEVKEKGMA

SEQ ID NO: 2268 - protein, 13 aa, Mus musculus
YKYFPEVKTKGMA

SEQ ID NO: 2269 - protein, 9 aa, Unknown
  epitope involved in diabetes
ARKVKGAAG

SEQ ID NO: 2270 - protein, 9 aa, Unknown
  epitope involved in diabetes
ARLSVVRNG

SEQ ID NO: 2271 - protein, 21 aa, Homo sapiens
DKVNFFRMVISNPAATHQDID

SEQ ID NO: 2272 - protein, 9 aa, Unknown
  epitope involved in diabetes
FRKADKFPM

SEQ ID NO: 2273 - protein, 9 aa, Unknown
  epitope involved in diabetes
FRKTSISGA

SEQ ID NO: 2274 - protein, 9 aa, Unknown
  epitope involved in diabetes
FRKTSKGGS

SEQ ID NO: 2275 - protein, 9 aa, Unknown
  epitope involved in diabetes
GGTTTPRTT

SEQ ID NO: 2276 - protein, 9 aa, Unknown
  epitope involved in diabetes
GRKSAVSPA

SEQ ID NO: 2277 - protein, 9 aa, Unknown
  epitope involved in diabetes
HKKSLSSPS

SEQ ID NO: 2278 - protein, 9 aa, Unknown
  epitope involved in diabetes
HRKSTVAGS

SEQ ID NO: 2279 - protein, 9 aa, Unknown
  epitope involved in diabetes
KGKKALQSA

SEQ ID NO: 2280 - protein, 9 aa, Unknown
  epitope involved in diabetes
KKKKYAEAV

SEQ ID NO: 2281 - protein, 9 aa, Unknown
  epitope involved in diabetes
KKTKGLVTT

SEQ ID NO: 2282 - protein, 9 aa, Unknown
  epitope involved in diabetes
KRRASAGGP

SEQ ID NO: 2283 - protein, 9 aa, Unknown
  epitope involved in diabetes
KSVKPRQAT

SEQ ID NO: 2284 - protein, 9 aa, Unknown
  epitope involved in diabetes
LRKKGYDPG

SEQ ID NO: 2285 - protein, 9 aa, Unknown
  epitope involved in diabetes
LSRKKTLTT

SEQ ID NO: 2286 - protein, 13 aa, Homo sapiens
MFPEVKEKGMAAL

SEQ ID NO: 2287 - protein, 9 aa, Unknown
  epitope involved in diabetes
MRKANSPPT

SEQ ID NO: 2288 - protein, 9 aa, Unknown
  epitope involved in diabetes
MRKSTGTAS

SEQ ID NO: 2289 - protein, 9 aa, Unknown
  epitope involved in diabetes
NRKLKSNMM

SEQ ID NO: 2290 - protein, 9 aa, Unknown
  epitope involved in diabetes
NRRLLPMPE

SEQ ID NO: 2291 - protein, 9 aa, Unknown
  epitope involved in diabetes
QKKMVALSG

SEQ ID NO: 2292 - protein, 9 aa, Unknown
  epitope involved in diabetes
QKRAKGLSA

SEQ ID NO: 2293 - protein, 9 aa, Unknown
  epitope involved in diabetes
RGLKSKIAM

SEQ ID NO: 2294 - protein, 9 aa, Unknown
  epitope involved in diabetes
RKKKPPGLA

SEQ ID NO: 2295 - protein, 9 aa, Unknown
  epitope involved in diabetes
RKLAHPGTS

SEQ ID NO: 2296 - protein, 9 aa, Unknown
  epitope involved in diabetes
RKRTRHLEG

SEQ ID NO: 2297 - protein, 9 aa, Unknown
  epitope involved in diabetes
RKTALGTRQ

SEQ ID NO: 2298 - protein, 9 aa, Unknown
  epitope involved in diabetes
RKVVQTSLE

SEQ ID NO: 2299 - protein, 9 aa, Unknown
  epitope involved in diabetes
RRKLRTNAG

SEQ ID NO: 2300 - protein, 9 aa, Unknown
  epitope involved in diabetes
RRKPGTEQL

SEQ ID NO: 2301 - protein, 9 aa, Unknown
  epitope involved in diabetes
RSLKTKLPS

SEQ ID NO: 2302 - protein, 9 aa, Unknown
  epitope involved in diabetes
SRKATASLP

SEQ ID NO: 2303 - protein, 9 aa, Unknown
  epitope involved in diabetes
SRKKTFTGA

SEQ ID NO: 2304 - protein, 9 aa, Unknown
  epitope involved in diabetes
SRKSGSLTK

SEQ ID NO: 2305 - protein, 9 aa, Unknown
  epitope involved in diabetes
SRKVALQGG

SEQ ID NO: 2306 - protein, 9 aa, Unknown
  epitope involved in diabetes
TKLSNTPSP

SEQ ID NO: 2307 - protein, 9 aa, Unknown
  epitope involved in diabetes
TQDLGYSRV

SEQ ID NO: 2308 - protein, 9 aa, Unknown
  epitope involved in diabetes
TRGLKGAPQ

SEQ ID NO: 2309 - protein, 9 aa, Unknown
  epitope involved in diabetes
TRKALTQNT

SEQ ID NO: 2310 - protein, 20 aa, Homo sapiens
VFDGKPQHTNVCFWYIPPSL

SEQ ID NO: 2311 - protein, 20 aa, Homo sapiens
VNFFRMVISNPAATHQDIDF

SEQ ID NO: 2312 - protein, 9 aa, Unknown
  epitope involved in diabetes
VRKLTVTSA

SEQ ID NO: 2313 - protein, 9 aa, Unknown
  epitope involved in diabetes
YKKGARPIQ

SEQ ID NO: 2314 - protein, 9 aa, Unknown
  epitope involved in diabetes
YRKKSSAEL

SEQ ID NO: 2315 - protein, 9 aa, Unknown
  epitope involved in diabetes
YRKTAKEGT

SEQ ID NO: 2316 - protein, 29 aa, Rubella virus
EACVTSWLWSEGEGAVFYRVDLHFINLGT

SEQ ID NO: 2317 - protein, 21 aa, Rubella virus
MDFWCVEHDRPPPATPTSLTT

SEQ ID NO: 2318 - protein, 15 aa, Homo sapiens
NMFTYEIAPVFVLME

SEQ ID NO: 2319 - protein, 25 aa, Rubella virus
PFLGHDGHHGGTLRVGQHHRNASDV

SEQ ID NO: 2320 - protein, 21 aa, Rubella virus
RVKFHTETRTVWQLSVAGVSC

SEQ ID NO: 2321 - protein, 16 aa, Human coxsackievirus
KILPEVKEKHEFLSRL

SEQ ID NO: 2322 - protein, 17 aa, Homo sapiens
KMFPEVKEKGMAALPRL

SEQ ID NO: 2323 - protein, 17 aa, Homo sapiens
KYFPEVKTKGMAAVPKL

SEQ ID NO: 2324 - protein, 7 aa, Unknown
  epitope involved in diabetes
KRSRLDV

SEQ ID NO: 2325 - protein, 7 aa, Unknown
  epitope involved in diabetes
LGRGGSK

SEQ ID NO: 2326 - protein, 7 aa, Unknown
  epitope involved in diabetes
RLGKRDS

SEQ ID NO: 2327 - protein, 7 aa, Unknown
  epitope involved in diabetes
RQLGRGS

SEQ ID NO: 2328 - protein, 7 aa, Unknown
  epitope involved in diabetes
STVQDCV

SEQ ID NO: 2329 - protein, 7 aa, Unknown
  epitope involved in diabetes
YLGRGDK

SEQ ID NO: 2330 - protein, 12 aa, Photobacterium phosphoreum
AKVAIVIARFNS

SEQ ID NO: 2331 - protein, 12 aa, Human herpesvirus
GGVAVVIGRFFG

SEQ ID NO: 2332 - protein, 12 aa, Synechocystis sp.
SAIGIYLGRFLR

SEQ ID NO: 2333 - protein, 10 aa, Mus musculus
HLCGPHLVEA

SEQ ID NO: 2334 - protein, 9 aa, Mus musculus
IVDQCCTSI

SEQ ID NO: 2335 - protein, 9 aa, Mus musculus
LLVHFLPLL

SEQ ID NO: 2336 - protein, 13 aa, Streptococcus pneumoniae
DDIMMSYAAKGFV

SEQ ID NO: 2337 - protein, 13 aa, Rickettsia prowazekii
ELVLMSYRDKLVL

SEQ ID NO: 2338 - protein, 13 aa, Human herpesvirus
KELLQSYVSKNNN

SEQ ID NO: 2339 - protein, 13 aa, Legionella pneumophila
KMSLLQYIVKNKI

SEQ ID NO: 2340 - protein, 13 aa, Lactococcus lactis
LVILPMFHVSGLS

SEQ ID NO: 2341 - protein, 13 aa, Homo sapiens
PIILPLWHVGEPG

SEQ ID NO: 2342 - protein, 13 aa, Homo sapiens
PIILPLWHVGMND

SEQ ID NO: 2343 - protein, 13 aa, Neisseria meningitidis
PVILPQWQSLGNR

SEQ ID NO: 2344 - protein, 13 aa, Staphylococcus aureus
PYVLLAYIVKSVG

SEQ ID NO: 2345 - protein, 13 aa, Chlamydia pneumoniae
QAMNILYQTVQAF

SEQ ID NO: 2346 - protein, 13 aa, Streptococcus pyogenes
REILPQYQLVILA

SEQ ID NO: 2347 - protein, 13 aa, Homo sapiens
TTLLPQWRVSAFV

SEQ ID NO: 2348 - protein, 12 aa, Homo sapiens
AYAKDVKFGADA

SEQ ID NO: 2349 - protein, 13 aa, Mus musculus
LSKVAPVIKARMM

SEQ ID NO: 2350 - protein, 10 aa, Unknown
  epitope involved in diabetes
SRLGLWVRME

SEQ ID NO: 2351 - protein, 14 aa, Mus musculus
WSRMDQLAKELTAE

SEQ ID NO: 2352 - protein, 18 aa, Mus musculus
FLPLLALLALWEPKPTQA

SEQ ID NO: 2353 - protein, 20 aa, Homo sapiens
GGGPGAGSLQPLALEGSLQK

SEQ ID NO: 2354 - protein, 24 aa, Homo sapiens
KLKVESSPSRSDYINASPIIEHDP

SEQ ID NO: 2355 - protein, 28 aa, Homo sapiens
LAKEWQALCAYQAEPNTCATAQGEGNIK

SEQ ID NO: 2356 - protein, 20 aa, Homo sapiens
SFYLKNVQTQETRTLTQFHF

SEQ ID NO: 2357 - protein, 22 aa, Homo sapiens
SKDQFEFALTAVAEEVNAILKA

SEQ ID NO: 2358 - protein, 29 aa, Homo sapiens
SRVSSVSSQFSDAAQASPSSHSSTPSWCE

SEQ ID NO: 2359 - protein, 12 aa, Homo sapiens
AFLQDVMNILLQ

SEQ ID NO: 2360 - protein, 19 aa, Homo sapiens
ALLRCIPALDSLTPANEDC

SEQ ID NO: 2361 - protein, 12 aa, Homo sapiens
APKRPGPAGELL

SEQ ID NO: 2362 - protein, 12 aa, Human coxsackievirus
ATCRFYTLDSIK

SEQ ID NO: 2363 - protein, 12 aa, Human coxsackievirus
DINTVTTVAQSR

SEQ ID NO: 2364 - protein, 12 aa, Human coxsackievirus
DRVRSITLGNST

SEQ ID NO: 2365 - protein, 12 aa, Homo sapiens
EEIAQVATISAN

SEQ ID NO: 2366 - protein, 12 aa, Human coxsackievirus
ETSLSAAGNSII

SEQ ID NO: 2367 - protein, 12 aa, Homo sapiens
FFRMVISNPAAT

SEQ ID NO: 2368 - protein, 12 aa, Homo sapiens
GADIKKTMEGPV

SEQ ID NO: 2369 - protein, 12 aa, Homo sapiens
GVELRQLTPEQL

SEQ ID NO: 2370 - protein, 12 aa, Homo sapiens
KDVKFGADARAL

SEQ ID NO: 2371 - protein, 16 aa, Homo sapiens
KEQFEFALTAVAEEVC

SEQ ID NO: 2372 - protein, 12 aa, Homo sapiens
KFGADARALMLQ

SEQ ID NO: 2373 - protein, 12 aa, Homo sapiens
KTGHPRYFNQLS

SEQ ID NO: 2374 - protein, 12 aa, Human coxsackievirus
LLESQIATIEQT

SEQ ID NO: 2375 - protein, 12 aa, Homo sapiens
LLQYVVKSFDRS

SEQ ID NO: 2376 - protein, 12 aa, Homo sapiens
LRLLLCLLLLSS

SEQ ID NO: 2377 - protein, 12 aa, Homo sapiens
LRQLTPEQLSTL

SEQ ID NO: 2378 - protein, 12 aa, Human coxsackievirus
LTAVETGHTSQV

SEQ ID NO: 2379 - protein, 12 aa, Homo sapiens
LTRAYAKDVKFG

SEQ ID NO: 2380 - protein, 12 aa, Homo sapiens
PPEPRPRDRSGL

SEQ ID NO: 2381 - protein, 12 aa, Homo sapiens
PRPRDRSGLAPK

SEQ ID NO: 2382 - protein, 12 aa, Human coxsackievirus
PSNSASVPALTA

SEQ ID NO: 2383 - protein, 12 aa, Homo sapiens
PTLAFLQDVMNI

SEQ ID NO: 2384 - protein, 23 aa, Human coxsackievirus
PVKDVMIKSLPAPALNSPTVEEC

SEQ ID NO: 2385 - protein, 12 aa, Homo sapiens
RDRSGLAPKRPG

SEQ ID NO: 2386 - protein, 12 aa, Homo sapiens
RLRPPEPRPRDR

SEQ ID NO: 2387 - protein, 12 aa, Human coxsackievirus
RSGPSNSASVPA

SEQ ID NO: 2388 - protein, 12 aa, Human coxsackievirus
RSITLGNSTITT

SEQ ID NO: 2389 - protein, 12 aa, Homo sapiens
RTALLDAAGVAS

SEQ ID NO: 2390 - protein, 12 aa, Human coxsackievirus
SASVPALTAVET

SEQ ID NO: 2391 - protein, 12 aa, Homo sapiens
SGGLRLLLCLLL

SEQ ID NO: 2392 - protein, 12 aa, Homo sapiens
SGLAPKRPGPAG

SEQ ID NO: 2393 - protein, 12 aa, Human coxsackievirus
SLEKKMSNYIQF

SEQ ID NO: 2394 - protein, 12 aa, Human coxsackievirus
SQIATIEQTAPS

SEQ ID NO: 2395 - protein, 12 aa, Human coxsackievirus
TKQMVQMRRKLE

SEQ ID NO: 2396 - protein, 12 aa, Human coxsackievirus
TRKDINTVTTVA

SEQ ID NO: 2397 - protein, 12 aa, Human coxsackievirus
VETGHTSQVTPS

SEQ ID NO: 2398 - protein, 12 aa, Homo sapiens
VKEKGMAALPRL

SEQ ID NO: 2399 - protein, 17 aa, Human coxsackievirus
VMIKSLPALNSPTVEEC

SEQ ID NO: 2400 - protein, 12 aa, Human coxsackievirus
VPALTAVETGHT

SEQ ID NO: 2401 - protein, 14 aa, Mus musculus
EYVTLKKMREIIGW

SEQ ID NO: 2402 - protein, 20 aa, Homo sapiens
DVMNILLQYVVKSFDRSTKV

SEQ ID NO: 2403 - protein, 20 aa, Homo sapiens
GAGSLQPLALEGSLQKRGIV

SEQ ID NO: 2404 - protein, 20 aa, Homo sapiens
KDYRAYYTFLNFMSNVGDPR

SEQ ID NO: 2405 - protein, 20 aa, Homo sapiens
KVNFFRMVISNPAATHQDID

SEQ ID NO: 2406 - protein, 20 aa, Homo sapiens
LIAFTSEHSHFSLKKGAAAL

SEQ ID NO: 2407 - protein, 20 aa, Homo sapiens
RLQQLVLDPGFLGLEPLLDL

SEQ ID NO: 2408 - protein, 20 aa, Porphyromonas gingivalis
TLVVNRLRGSLKICAVKAPG

SEQ ID NO: 2409 - protein, 11 aa, Unknown
  epitope involved in diabetes
AHHPIWARMDA

SEQ ID NO: 2410 - protein, 14 aa, Mus musculus
DTKVMKCVLEVISD

SEQ ID NO: 2411 - protein, 20 aa, Homo sapiens
DSVILIKCDERGKMIPSDLE

SEQ ID NO: 2412 - protein, 20 aa, Homo sapiens
HKWKLSGVERANSVTWNPHK

SEQ ID NO: 2413 - protein, 20 aa, Homo sapiens
KCLELAEYLYNIIKNREGYE

SEQ ID NO: 2414 - protein, 20 aa, Homo sapiens
KGMAALPRLIAFTSEHSHFS

SEQ ID NO: 2415 - protein, 20 aa, Homo sapiens
RPTLAFLQDVMNILLQYVVK

SEQ ID NO: 2416 - protein, 20 aa, Homo sapiens
YDLSYDTGDKALQCGRHVDV

SEQ ID NO: 2417 - protein, 13 aa, Homo sapiens
IPALDSLTPANED

SEQ ID NO: 2418 - protein, 20 aa, Homo sapiens
PTIAFLQDVMNILLQYVVKS

SEQ ID NO: 2419 - protein, 15 aa, Unknown
  epitope involved in diabetes
SHLVEALYLVCGEEG

SEQ ID NO: 2420 - protein, 15 aa, Unknown
  epitope involved in diabetes
SHLVEALYLVCGGEG

SEQ ID NO: 2421 - protein, 369 aa, Homo sapiens
MEFLERTYLVNDKAAKMYAFTLESVELQQKPVNKDQCPRERPEELESGGMYHCHSGSKPTEKGANEYAYAKWKLCSASAICFIFMIAEVVGGHIAGSLAVVTDAAHLLIDLTSFLLSLFSLWLSSKPPSKRLTFGWHRAEILGALLSILCIWVVTGVLVYLACERLLYPDYQIQATVMIIVSSCAVAANIVLTVVLHQRCLGHNHKEVQANASVRAAFVHALGDLFQSISVLISALIIYFKPEYKIADPICTFIFSILVLASTITILKDFSILLMEGVPKSLNYSGVKELILAVDGVLSVHSLHIWSLTMNQVILSAHVATAASRDSQVVRREIAKALSKSFTMHSLTIQMESPVDQDPDCLFCEDPCD

SEQ ID NO: 2422 - protein, 18 aa, Homo sapiens
LPRLIAFTSEHSHFSLKK

SEQ ID NO: 2423 - protein, 14 aa, Homo sapiens
VNFFRMVISNPAAT

SEQ ID NO: 2424 - protein, 10 aa, Homo sapiens
PLALEGSLQK

SEQ ID NO: 2425 - protein, 10 aa, Homo sapiens
PLLALLALWG

SEQ ID NO: 2426 - protein, 12 aa, Mus musculus
ASSLGGNQDTQY

SEQ ID NO: 2427 - protein, 9 aa, Homo sapiens
ALGDLFQSI

SEQ ID NO: 2428 - protein, 10 aa, Homo sapiens
AVAANIVLTV

SEQ ID NO: 2429 - protein, 10 aa, Homo sapiens
FLLSLFSLWL

SEQ ID NO: 2430 - protein, 9 aa, Homo sapiens
HIAGSLAVV

SEQ ID NO: 2431 - protein, 10 aa, Homo sapiens
ILAVDGVLSV

SEQ ID NO: 2432 - protein, 9 aa, Homo sapiens
ILKDFSILL

SEQ ID NO: 2433 - protein, 10 aa, Homo sapiens
ILVLASTITI

SEQ ID NO: 2434 - protein, 9 aa, Homo sapiens
LLIDLTSFL

SEQ ID NO: 2435 - protein, 9 aa, Homo sapiens
SISVLISAL

SEQ ID NO: 2436 - protein, 9 aa, Homo sapiens
VVTGVLVYL

SEQ ID NO: 2437 - protein, 9 aa, Homo sapiens
FIFSILVLA

SEQ ID NO: 2438 - protein, 9 aa, Homo sapiens
IQATVMIIV

SEQ ID NO: 2439 - protein, 9 aa, Homo sapiens
KMYAFTLES

SEQ ID NO: 2440 - protein, 9 aa, Homo sapiens
KSLNYSGVK

SEQ ID NO: 2441 - protein, 9 aa, Homo sapiens
LLSILCIWV

SEQ ID NO: 2442 - protein, 9 aa, Homo sapiens
LLSLFSLWL

SEQ ID NO: 2443 - protein, 9 aa, Homo sapiens
MIIVSSCAV

SEQ ID NO: 2444 - protein, 9 aa, Homo sapiens
RLLYPDYQI

SEQ ID NO: 2445 - protein, 9 aa, Homo sapiens
TMHSLTIQM

SEQ ID NO: 2446 - protein, 9 aa, Homo sapiens
VAANIVLTV

SEQ ID NO: 2447 - protein, 27 aa, Homo sapiens
ACERLLYPDYQIQATVMIIVSSCAVAA

SEQ ID NO: 2448 - protein, 27 aa, Homo sapiens
AKMHAFTLESVELQQKPVNKDQCPRER

SEQ ID NO: 2449 - protein, 27 aa, Homo sapiens
ANEYAYAKWKLCSASAICFIFMIAEVV

SEQ ID NO: 2450 - protein, 34 aa, Homo sapiens
ASRDSQVVRREIAKALSKSFTMHSLTIQMESPVD

SEQ ID NO: 2451 - protein, 27 aa, Homo sapiens
DGVLSVHSLHIWSLTMNQVILSAHVAT

SEQ ID NO: 2452 - protein, 27 aa, Homo sapiens
EELESGGMYHCHSGSKPTEKGANEYAY

SEQ ID NO: 2453 - protein, 41 aa, Homo sapiens
FGWHRAEILGALLSILCIWVVTGVLVYLACERLLYPDYQIQ

SEQ ID NO: 2454 - protein, 27 aa, Homo sapiens
FIFSILVLASTITILKDFSILLMEGVP

SEQ ID NO: 2455 - protein, 27 aa, Homo sapiens
GHIAGSLAVVTDAAHLLIDLTSFLLSL

SEQ ID NO: 2456 - protein, 27 aa, Homo sapiens
HLLIDLTSFLLSLFSLWLSSKPPSKRL

SEQ ID NO: 2457 - protein, 27 aa, Homo sapiens
HQRCLGHNHKEVQANASVRAAFVHALG

SEQ ID NO: 2458 - protein, 27 aa, Homo sapiens
LFQSISVLISALIIYFKPEYKIADPIC

SEQ ID NO: 2459 - protein, 27 aa, Homo sapiens
LKDFSILLMEGVPKSLNYSGVKELILA

SEQ ID NO: 2460 - protein, 27 aa, Homo sapiens
MEFLERTYLVNDKAAKMHAFTLESVEL

SEQ ID NO: 2461 - protein, 26 aa, Homo sapiens
MHSLTIQMESPVDQDPDCLFCEDPCD

SEQ ID NO: 2462 - protein, 27 aa, Homo sapiens
NASVRAAFVHALGDLFQSISVLISALI

SEQ ID NO: 2463 - protein, 27 aa, Homo sapiens
QKPVNKDQCPRERPEELESGGMYHCHS

SEQ ID NO: 2464 - protein, 27 aa, Homo sapiens
SAICFIFMIAEVVGGHIAGSLAVVTDA

SEQ ID NO: 2465 - protein, 27 aa, Homo sapiens
SCAVAANIVLTVVLHQRCLGHNHKEVQ

SEQ ID NO: 2466 - protein, 27 aa, Homo sapiens
SLNYSGVKELILAVDGVLSVHSLHIWS

SEQ ID NO: 2467 - protein, 27 aa, Homo sapiens
SLWLSSKPPSKRLTFGWHRAEILGALL

SEQ ID NO: 2468 - protein, 27 aa, Homo sapiens
TMNQVILSAHVATAASRDSQVVRREIA

SEQ ID NO: 2469 - protein, 27 aa, Homo sapiens
YFKPEYKIADPICTFIFSILVLASTIT

SEQ ID NO: 2470 - protein, 9 aa, Mus musculus
AINSEMFLR

SEQ ID NO: 2471 - protein, 10 aa, Mus musculus
LALEVARQKR

SEQ ID NO: 2472 - protein, 10 aa, Mus musculus
TLALEVAQQK

SEQ ID NO: 2473 - protein, 10 aa, Mus musculus
TLALEVARQK

SEQ ID NO: 2474 - protein, 20 aa, Mycobacterium tuberculosis
TLVVNKIRGTFKSVAVKAPG

SEQ ID NO: 2475 - protein, 20 aa, Chlamydia pneumoniae
TLVVNKLQGLLQVTVVTIPQ

SEQ ID NO: 2476 - protein, 14 aa, Homo sapiens
LTVGLTRRGQPRQY

SEQ ID NO: 2477 - protein, 13 aa, Homo sapiens
YNQYSQRYHQRTN

SEQ ID NO: 2478 - protein, 9 aa, Homo sapiens
ACDGERPTL

SEQ ID NO: 2479 - protein, 9 aa, Homo sapiens
AHVDKCLEL

SEQ ID NO: 2480 - protein, 10 aa, Unknown
  epitope involved in diabetes
ALWGPDPAAV

SEQ ID NO: 2481 - protein, 9 aa, Homo sapiens
APVIKARMM

SEQ ID NO: 2482 - protein, 10 aa, Unknown
  epitope involved in diabetes
AQWGPDPAAV

SEQ ID NO: 2483 - protein, 10 aa, Homo sapiens
HPRYFNQLST

SEQ ID NO: 2484 - protein, 10 aa, Homo sapiens
IPSDLERRIL

SEQ ID NO: 2485 - protein, 10 aa, Unknown
  epitope involved in diabetes
RQWGPDPAAV

SEQ ID NO: 2486 - protein, 9 aa, Homo sapiens
SPGSGFWSF

SEQ ID NO: 2487 - protein, 1015 aa, Homo sapiens
MGPPLPLLLLLLLLLPPRVLPAAPSSVPRGRQLPGRLGCLLEEGLCGASEACVNDGVFGRCQKVPAMDFYRYEVSPVALQRLRVALQKLSGTGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGSRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 2488 - protein, 979 aa, Homo sapiens; identical to SEQ ID NO: 2028

SEQ ID NO: 2489 - protein, 11 aa, Homo sapiens
ERLGPLVEQGR

SEQ ID NO: 2490 - protein, 20 aa, Mus musculus
KCNTATCATQRALNFLVRSS

SEQ ID NO: 2491 - protein, 18 aa, Mus musculus
FAINSEMFLRSCQGENGT

SEQ ID NO: 2492 - protein, 18 aa, Mus musculus
FIKIPTHAEPLFYLLSFC

SEQ ID NO: 2493 - protein, 18 aa, Mus musculus
LTTMQLYRFIKIPTHAEP

SEQ ID NO: 2494 - protein, 18 aa, Mus musculus
TKMIWVAVIGDWFNLIFK

SEQ ID NO: 2495 - protein, 7 aa, Mycobacterium avium
GDSARVL

SEQ ID NO: 2496 - protein, 7 aa, Mycobacterium avium
HATVQID

SEQ ID NO: 2497 - protein, 7 aa, Mycobacterium avium
HLISTGD

SEQ ID NO: 2498 - protein, 9 aa, Mycobacterium avium
LAANFVVAL

SEQ ID NO: 2499 - protein, 7 aa, Mycobacterium avium
LSPGKDM

SEQ ID NO: 2500 - protein, 9 aa, Mycobacterium avium
MIAVALAGL

SEQ ID NO: 2501 - protein, 15 aa, Homo sapiens
ERTYLVNDKAAKMHA

SEQ ID NO: 2502 - protein, 15 aa, Homo sapiens
IFSILVLASTITILK

SEQ ID NO: 2503 - protein, 23 aa, Homo sapiens
KERLAALGPEGAHGDTTFEYQDL

SEQ ID NO: 2504 - protein, 14 aa, Homo sapiens
YAYAKWKLCSASAI

SEQ ID NO: 2505 - protein, 15 aa, Homo sapiens
YKIADPICTFIFSIL

SEQ ID NO: 2506 - protein, 20 aa, Mycobacterium tuberculosis
AASGPKVVIDGKDQNVTGSV

SEQ ID NO: 2507 - protein, 20 aa, Human herpesvirus
AGAGGGAGGAGAGGGAGGAG

SEQ ID NO: 2508 - protein, 21 aa, Human herpesvirus
AGAGGGAGGAGAGGGAGGAGA

SEQ ID NO: 2509 - protein, 15 aa, Mycobacterium tuberculosis
AGKPLLIIAEDVEGE

SEQ ID NO: 2510 - protein, 13 aa, Homo sapiens
AGWLADRSVRYPI

SEQ ID NO: 2511 - protein, 10 aa, Mycobacterium tuberculosis
ALSTLVVNKI

SEQ ID NO: 2512 - protein, 15 aa, Mycobacterium tuberculosis
ALSTLVVNKIRGTFK

SEQ ID NO: 2513 - protein, 20 aa, Mycobacterium tuberculosis
ASATKDGSHYKITGTATGVD

SEQ ID NO: 2514 - protein, 20 aa, Mycobacterium tuberculosis
ATGVDMANPMSPVNKSFEIE

SEQ ID NO: 2515 - protein, 10 aa, Human herpesvirus
AVFDRKSDAK

SEQ ID NO: 2516 - protein, 9 aa, Human herpesvirus
AYRRRWRRL

SEQ ID NO: 2517 - protein, 9 aa, Human herpesvirus
CLGGLLTMV

SEQ ID NO: 2518 - protein, 19 aa, Mycobacterium leprae
DAWREGEEFVVEFDLPGIK

SEQ ID NO: 2519 - protein, 20 aa, Mycobacterium tuberculosis
DGNPPEVKSVGLGNVNGVTL

SEQ ID NO: 2520 - protein, 16 aa, Mycobacterium tuberculosis
DLSLLGKARKVVVTKD

SEQ ID NO: 2521 - protein, 12 aa, Human herpesvirus
DSELEIKRYKNR

SEQ ID NO: 2522 - protein, 15 aa, Homo sapiens
DTQFVRFDSDAASQR

SEQ ID NO: 2523 - protein, 15 aa, Mycobacterium bovis
DVEGEALSTLVVNKI

SEQ ID NO: 2524 - protein, 15 aa, Mycobacterium tuberculosis
EESNTFGLQLELTEG

SEQ ID NO: 2525 - protein, 9 aa, Human herpesvirus
ELKRKMIYM

SEQ ID NO: 2526 - protein, 15 aa, Homo sapiens
ENPVVHFFKNIVTPR

SEQ ID NO: 2527 - protein, 11 aa, Human herpesvirus
EPLPQGQLTAY

SEQ ID NO: 2528 - protein, 6 aa, Proteus mirabilis
ESRRAL

SEQ ID NO: 2529 - protein, 16 aa, Homo sapiens
FDQKIVEWDSRKSKYF

SEQ ID NO: 2530 - protein, 9 aa, Human herpesvirus
FLRGRAYGL

SEQ ID NO: 2531 - protein, 18 aa, Homo sapiens
FPKPPSYNVATTLPSYDE

SEQ ID NO: 2532 - protein, 20 aa, Human herpesvirus
GAGGGAGGAGAGGGAGGAGA

SEQ ID NO: 2533 - protein, 24 aa, Human herpesvirus
GGDNHGRGRGRGRGRGGGRPGAPG

SEQ ID NO: 2534 - protein, 24 aa, Human herpesvirus
GGDNHGRGRGRGRGRGGGRPGAPG

SEQ ID NO: 2535 - protein, 24 aa, Human herpesvirus
GGDNHGRGRGRGRGRGGGRPGAPG

SEQ ID NO: 2536 - protein, 24 aa, Human herpesvirus
GGDNHGRGRGRGRGRGGGRPGAPG

SEQ ID NO: 2537 - protein, 15 aa, Phaseolus vulgaris
GGYGDGGAHGGGYGG

SEQ ID NO: 2538 - protein, 9 aa, Human herpesvirus
GLCTLVAML

SEQ ID NO: 2539 - protein, 10 aa, Mycobacterium tuberculosis
GLEPGVVAEK

SEQ ID NO: 2540 - protein, 11 aa, Mycobacterium tuberculosis
GLEPGVVAEKV

SEQ ID NO: 2541 - protein, 16 aa, Mycobacterium leprae
GMEPGVVAEKVRNLSV

SEQ ID NO: 2542 - protein, 15 aa, Mycobacterium tuberculosis
IAFNSGLEPGVVAEK

SEQ ID NO: 2543 - protein, 16 aa, Mycobacterium leprae
IAFNSGMEPGVVAEKV

SEQ ID NO: 2544 - protein, 20 aa, Mycobacterium tuberculosis
IAIGGAATGIAAVLTDGNPP

SEQ ID NO: 2545 - protein, 15 aa, Homo sapiens
KDLLEQKRAAVDTYC

SEQ ID NO: 2546 - protein, 14 aa, Human herpesvirus
KGGWFGKHRGQGGS

SEQ ID NO: 2547 - protein, 22 aa, Artemia franciscana
KKEEKKEESEEEDEDMGFGLFD

SEQ ID NO: 2548 - protein, 9 aa, Human herpesvirus
KRKMIYMCY

SEQ ID NO: 2549 - protein, 9 aa, Human herpesvirus
KRPPIFIRR

SEQ ID NO: 2550 - protein, 9 aa, Human herpesvirus
LLWTLVVLL

SEQ ID NO: 2551 - protein, 15 aa, Mycobacterium tuberculosis
MAKTIAYDEEARRGL

SEQ ID NO: 2552 - protein, 15 aa, Mycobacterium tuberculosis
MSPVNKSFEIEVTCS

SEQ ID NO: 2553 - protein, 9 aa, Human herpesvirus
NLVPMVATV

SEQ ID NO: 2554 - protein, 13 aa, Influenza A virus
PKYVKQNTLKLAT

SEQ ID NO: 2555 - protein, 13 aa, Unknown
  epitope involved in rheumatoid arthritis
PKYVKRNTLKLAT

SEQ ID NO: 2556 - protein, 12 aa, Clostridium tetani
PLYKKMEAVKLR

SEQ ID NO: 2557 - protein, 15 aa, Mycobacterium sp.
PYILLVSSKVSTVKD

SEQ ID NO: 2558 - protein, 16 aa, Homo sapiens
QPHDLGKVGEVIVTKD

SEQ ID NO: 2559 - protein, 8 aa, Human herpesvirus
RAKFKQLL

SEQ ID NO: 2560 - protein, 14 aa, Human herpesvirus
RARGRGRGRGEKRP

SEQ ID NO: 2561 - protein, 15 aa, Human herpesvirus
RRGRGRERARGGSRE

SEQ ID NO: 2562 - protein, 9 aa, Human herpesvirus
RRIEEICMK

SEQ ID NO: 2563 - protein, 9 aa, Human herpesvirus
RRLVVTLQC

SEQ ID NO: 2564 - protein, 9 aa, Human herpesvirus
SENDRLRLL

SEQ ID NO: 2565 - protein, 20 aa, Mycobacterium tuberculosis
SGETTTAAGTTASPGAASGP

SEQ ID NO: 2566 - protein, 13 aa, Influenza A virus
SGPLKAEIAQRLE

SEQ ID NO: 2567 - protein, 7 aa, Mus musculus
SLAYGLR

SEQ ID NO: 2568 - protein, 16 aa, Mycobacterium tuberculosis
SVAVKAPGFGDRRKAM

SEQ ID NO: 2569 - protein, 9 aa, Human herpesvirus
SVRDRLARL

SEQ ID NO: 2570 - protein, 9 aa, Unknown
  epitope involved in rheumatoid arthritis
TFGAQLELT

SEQ ID NO: 2571 - protein, 9 aa, Mycobacterium tuberculosis
TFGLQLELT

SEQ ID NO: 2572 - protein, 15 aa, Human T-cell lymphotrophic virus
TNSHVPILQERPPLE

SEQ ID NO: 2573 - protein, 20 aa, Mycobacterium tuberculosis
VAGLSGCSSNKSTTGSGETT

SEQ ID NO: 2574 - protein, 17 aa, Homo sapiens
VDDTQFVRFDSDAASQR

SEQ ID NO: 2575 - protein, 19 aa, Homo sapiens
VDDTQFVRFDSDAASQRME

SEQ ID NO: 2576 - protein, 20 aa, Homo sapiens
VDDTQFVRFDSDAASQRMEP

SEQ ID NO: 2577 - protein, 21 aa, Homo sapiens
VDDTQFVRFDSDAASQRMEPR

SEQ ID NO: 2578 - protein, 20 aa, Mycobacterium tuberculosis
VTGSVVCTTAAGNVNIAIGG

SEQ ID NO: 2579 - protein, 15 aa, Mycobacterium bovis
VVAEKVRNLPAGHGL

SEQ ID NO: 2580 - protein, 9 aa, Human herpesvirus
YVLDHLIVV

SEQ ID NO: 2581 - protein, 20 aa, Homo sapiens
KFGADARALMLQGVDLLADA

SEQ ID NO: 2582 - protein, 22 aa, Human herpesvirus
GGAGAGGGAGGAGAGGGAGGAG

SEQ ID NO: 2583 - protein, 11 aa, Homo sapiens
GLKGEQGEPGA

SEQ ID NO: 2584 - protein, 11 aa, Gallus gallus
IAGFKGEQGPK

SEQ ID NO: 2585 - protein, 20 aa, Mycobacterium tuberculosis
MKRGLTVAVAGAAILVAGLS

SEQ ID NO: 2586 - protein, 20 aa, Mycobacterium tuberculosis
NGVTLGYTSGTCQGNASATK

SEQ ID NO: 2587 - protein, 26 aa, Gallus gallus
PTGPLGPKGQTGELGIAGFKGEQGPK

SEQ ID NO: 2588 - protein, 9 aa, Unknown
  epitope involved in rheumatoid arthritis
ADGGAQGTA

SEQ ID NO: 2589 - protein, 12 aa, Unknown
  epitope involved in rheumatoid arthritis
ADIWLTPDPTTP

SEQ ID NO: 2590 - protein, 15 aa, Homo sapiens
CVDTRSGNCYLDIRP

SEQ ID NO: 2591 - protein, 12 aa, Unknown
  epitope involved in rheumatoid arthritis
DVYWLMPDPPTS

SEQ ID NO: 2592 - protein, 15 aa, Homo sapiens
EPVSGSFTTALDGPS

SEQ ID NO: 2593 - protein, 15 aa, Homo sapiens
FFYFFTGSSQLEFDP

SEQ ID NO: 2594 - protein, 15 aa, Rattus norvegicus
GIAGFKGEQGPKGET

SEQ ID NO: 2595 - protein, 21 aa, Homo sapiens
GPKGQTGEPGIAGFKGEQGPK

SEQ ID NO: 2596 - protein, 21 aa, Homo sapiens
GPKGQTGKPGIAGFKGEQGPK

SEQ ID NO: 2597 - protein, 12 aa, Unknown
  epitope involved in rheumatoid arthritis
GTSTEVWLAPDP

SEQ ID NO: 2598 - protein, 15 aa, Homo sapiens
GVVSHSFPATLETQE

SEQ ID NO: 2599 - protein, 12 aa, Unknown
  epitope involved in rheumatoid arthritis
HLPSFLRPDPPL

SEQ ID NO: 2600 - protein, 12 aa, Unknown
  epitope involved in rheumatoid arthritis
IFPSFLRPDPPL

SEQ ID NO: 2601 - protein, 15 aa, Homo sapiens
ISGLPSGGDDLETST

SEQ ID NO: 2602 - protein, 15 aa, Homo sapiens
IWYINCFGCETHAML

SEQ ID NO: 2603 - protein, 15 aa, Homo sapiens
LSGLPSGGEVLEISV

SEQ ID NO: 2604 - protein, 9 aa, Unknown
  epitope involved in rheumatoid arthritis
LSSREPQAR

SEQ ID NO: 2605 - protein, 11 aa, Rattus norvegicus
LVGPRGERGFP

SEQ ID NO: 2606 - protein, 17 aa, Homo sapiens
NEEGFFSARGHRPLDKK

SEQ ID NO: 2607 - protein, 12 aa, Unknown
  epitope involved in rheumatoid arthritis
NSDHFLQPDPPL

SEQ ID NO: 2608 - protein, 9 aa, Unknown
  epitope involved in rheumatoid arthritis
PGPSRAHFL

SEQ ID NO: 2609 - protein, 15 aa, Escherichia coli
QKRAAYDQYGHAAFE

SEQ ID NO: 2610 - protein, 9 aa, Unknown
  epitope involved in rheumatoid arthritis
RLTRELYAQ

SEQ ID NO: 2611 - protein, 13 aa, Homo sapiens
RSFTLASSETGVG

SEQ ID NO: 2612 - protein, 15 aa, Homo sapiens
VKEGHSPPDDVDIVI

SEQ ID NO: 2613 - protein, 16 aa, Homo sapiens
VYATRSSAVRLRSSVP

SEQ ID NO: 2614 - protein, 9 aa, Unknown
  epitope involved in rheumatoid arthritis
YTQKHKHQA

SEQ ID NO: 2615 - protein, 13 aa, Bos taurus
AGFKGEQGPKGEP

SEQ ID NO: 2616 - protein, 11 aa, Homo sapiens
ARGLTGRPGDA

SEQ ID NO: 2617 - protein, 15 aa, Mus musculus
ATEGQVRVNSIYQDK

SEQ ID NO: 2618 - protein, 15 aa, Bos taurus
ATYKRRLQKRSSRPL

SEQ ID NO: 2619 - protein, 21 aa, Unknown
  epitope involved in rheumatoid arthritis
GEPGIAGFKGDQGPKGEPGPA

SEQ ID NO: 2620 - protein, 12 aa, Rattus norvegicus
GIAGFKGEQGPK

SEQ ID NO: 2621 - protein, 15 aa, Rattus norvegicus
GIAGFKGEQGPKGET

SEQ ID NO: 2622 - protein, 8 aa, Homo sapiens
LKFVEQNE

SEQ ID NO: 2623 - protein, 15 aa, Mus musculus
NTYKHRLQKRTMRPT

SEQ ID NO: 2624 - protein, 13 aa, Homo sapiens
PTFGRSFTLASSE

SEQ ID NO: 2625 - protein, 26 aa, Unknown
  epitope involved in rheumatoid arthritis
PTGPLGPKGQTGELGAPGNKGEQGPK

SEQ ID NO: 2626 - protein, 14 aa, Homo sapiens
SQRFSKIASNTQSR

SEQ ID NO: 2627 - protein, 15 aa, Canis lupus
STYKRRLQKRSSRAP

SEQ ID NO: 2628 - protein, 20 aa, Homo sapiens
TGEPGIAGFKGEQGPKGEPG

SEQ ID NO: 2629 - protein, 15 aa, Unknown
  epitope involved in rheumatoid arthritis
TTYKRRLQKRAARHP

SEQ ID NO: 2630 - protein, 9 aa, Homo sapiens
TYKRRLQKR

SEQ ID NO: 2631 - protein, 14 aa, Sus scrofa
TYKRRLQKRSSRSL

SEQ ID NO: 2632 - protein, 13 aa, Homo sapiens
VGYDDQESVKSKV

SEQ ID NO: 2633 - protein, 18 aa, Homo sapiens
AGMDMCSAGWLADRSVRY

SEQ ID NO: 2634 - protein, 7 aa, Homo sapiens
ALPAPIE

SEQ ID NO: 2635 - protein, 7 aa, Homo sapiens
APIEKTI

SEQ ID NO: 2636 - protein, 7 aa, Homo sapiens
CKVSNKA

SEQ ID NO: 2637 - protein, 7 aa, Homo sapiens
DGKEYKC

SEQ ID NO: 2638 - protein, 7 aa, Homo sapiens
DVSHEDP

SEQ ID NO: 2639 - protein, 7 aa, Homo sapiens
EDPQVKF

SEQ ID NO: 2640 - protein, 7 aa, Homo sapiens
EKTISKA

SEQ ID NO: 2641 - protein, 6 aa, Homo sapiens
EQRRAA

SEQ ID NO: 2642 - protein, 7 aa, Homo sapiens
EYKCKVS

SEQ ID NO: 2643 - protein, 7 aa, Homo sapiens
FLFPPKP

SEQ ID NO: 2644 - protein, 7 aa, Homo sapiens
FNWYVDG

SEQ ID NO: 2645 - protein, 7 aa, Homo sapiens
FPPKPKD

SEQ ID NO: 2646 - protein, 16 aa, Bos taurus
GARGPEGAQGPRGEPG

SEQ ID NO: 2647 - protein, 15 aa, Bos taurus
GEPGIAGFKGEQGPK

SEQ ID NO: 2648 - protein, 15 aa, Rattus norvegicus
GEPGIAGFKGEQGPK

SEQ ID NO: 2649 - protein, 15 aa, Rattus norvegicus
GEPGIAGFKGEQGPK

SEQ ID NO: 2650 - protein, 7 aa, Homo sapiens
GKEYKCK

SEQ ID NO: 2651 - protein, 16 aa, Homo sapiens
GKPGIAGFKGEQGPKG

SEQ ID NO: 2652 - protein, 16 aa, Homo sapiens
GNQWVGYDDQESVKSK

SEQ ID NO: 2653 - protein, 7 aa, Homo sapiens
GPSVFLF

SEQ ID NO: 2654 - protein, 11 aa, Homo sapiens
GRGDSVVYGLR

SEQ ID NO: 2655 - protein, 16 aa, Homo sapiens
GRSFTLASSETGVGAP

SEQ ID NO: 2656 - protein, 15 aa, Homo sapiens
GTSLTIPCYFIDPMH

SEQ ID NO: 2657 - protein, 7 aa, Homo sapiens
GVQVHNA

SEQ ID NO: 2658 - protein, 7 aa, Homo sapiens
HQNWLDG

SEQ ID NO: 2659 - protein, 7 aa, Homo sapiens
IEKTISK

SEQ ID NO: 2660 - protein, 7 aa, Homo sapiens
ISKAKGQ

SEQ ID NO: 2661 - protein, 7 aa, Homo sapiens
KALPAPI

SEQ ID NO: 2662 - protein, 7 aa, Homo sapiens
KCKVSNK

SEQ ID NO: 2663 - protein, 7 aa, Homo sapiens
KEYKCKV

SEQ ID NO: 2664 - protein, 7 aa, Homo sapiens
KFNWYVD

SEQ ID NO: 2665 - protein, 15 aa, Gallus gallus
KGQTGELGIAGFKGE

SEQ ID NO: 2666 - protein, 7 aa, Homo sapiens
KPREQQY

SEQ ID NO: 2667 - protein, 7 aa, Homo sapiens
KTISKAK

SEQ ID NO: 2668 - protein, 7 aa, Homo sapiens
KTKPREQ

SEQ ID NO: 2669 - protein, 7 aa, Homo sapiens
KVSNKAL

SEQ ID NO: 2670 - protein, 7 aa, Homo sapiens
LDGKEYK

SEQ ID NO: 2671 - protein, 7 aa, Homo sapiens
LFPPKPK

SEQ ID NO: 2672 - protein, 33 aa, Homo sapiens
LGPKGQTGEPGIAGFKGEQGPKGEPGPAGPQGA

SEQ ID NO: 2673 - protein, 7 aa, Homo sapiens
LHQNWLD

SEQ ID NO: 2674 - protein, 7 aa, Homo sapiens
LPAPIEK

SEQ ID NO: 2675 - protein, 7 aa, Homo sapiens
LTVLHQN

SEQ ID NO: 2676 - protein, 16 aa, Homo sapiens
MGIPTFGRSFTLASSE

SEQ ID NO: 2677 - protein, 7 aa, Homo sapiens
NAKTKPR

SEQ ID NO: 2678 - protein, 16 aa, Homo sapiens
NFGSQRFSKIASNTQS

SEQ ID NO: 2679 - protein, 7 aa, Homo sapiens
NKALPAP

SEQ ID NO: 2680 - protein, 7 aa, Homo sapiens
NSTYRVV

SEQ ID NO: 2681 - protein, 7 aa, Homo sapiens
NWLDGKE

SEQ ID NO: 2682 - protein, 7 aa, Homo sapiens
NWYVDGV

SEQ ID NO: 2683 - protein, 7 aa, Homo sapiens
PAPIEKT

SEQ ID NO: 2684 - protein, 7 aa, Homo sapiens
PIEKTIS

SEQ ID NO: 2685 - protein, 7 aa, Homo sapiens
PQVKFNW

SEQ ID NO: 2686 - protein, 7 aa, Homo sapiens
PREQQYN

SEQ ID NO: 2687 - protein, 7 aa, Homo sapiens
PSVFLFP

SEQ ID NO: 2688 - protein, 16 aa, Homo sapiens
QHLDFISIMTYDFHGA

SEQ ID NO: 2689 - protein, 7 aa, Homo sapiens
QNWLDGK

SEQ ID NO: 2690 - protein, 7 aa, Homo sapiens
QQYNSTY

SEQ ID NO: 2691 - protein, 7 aa, Homo sapiens
QVKFNWY

SEQ ID NO: 2692 - protein, 16 aa, Homo sapiens
QWVGYDDQESVKSKVQ

SEQ ID NO: 2693 - protein, 7 aa, Homo sapiens
QYNSTYR

SEQ ID NO: 2694 - protein, 7 aa, Homo sapiens
REQQYNS

SEQ ID NO: 2695 - protein, 7 aa, Homo sapiens
RVVSVLT

SEQ ID NO: 2696 - protein, 16 aa, Homo sapiens
SCFPDALDRFLCTHII

SEQ ID NO: 2697 - protein, 7 aa, Homo sapiens
SNKALPA

SEQ ID NO: 2698 - protein, 7 aa, Homo sapiens
SVFLFPP

SEQ ID NO: 2699 - protein, 7 aa, Homo sapiens
SVLTVLH

SEQ ID NO: 2700 - protein, 7 aa, Homo sapiens
TISKAKG

SEQ ID NO: 2701 - protein, 7 aa, Homo sapiens
TVLHQNW

SEQ ID NO: 2702 - protein, 7 aa, Homo sapiens
TYRVVSV

SEQ ID NO: 2703 - protein, 7 aa, Homo sapiens
VDGVQVH

SEQ ID NO: 2704 - protein, 7 aa, Homo sapiens
VFLFPPK

SEQ ID NO: 2705 - protein, 7 aa, Homo sapiens
VHNAKTK

SEQ ID NO: 2706 - protein, 7 aa, Homo sapiens
VKFNWYV

SEQ ID NO: 2707 - protein, 7 aa, Homo sapiens
VLHQNWL

SEQ ID NO: 2708 - protein, 7 aa, Homo sapiens
VSNKALP

SEQ ID NO: 2709 - protein, 7 aa, Homo sapiens
VSVLTVL

SEQ ID NO: 2710 - protein, 18 aa, Homo sapiens
VVLLVATEGRVRVNSAYQ

SEQ ID NO: 2711 - protein, 7 aa, Homo sapiens
VVSVLTV

SEQ ID NO: 2712 - protein, 18 aa, Homo sapiens
VVVKGIVFHYRAISTRYT

SEQ ID NO: 2713 - protein, 7 aa, Homo sapiens
WLDGKEY

SEQ ID NO: 2714 - protein, 7 aa, Homo sapiens
WYVDGVQ

SEQ ID NO: 2715 - protein, 7 aa, Homo sapiens
YKCKVSN

SEQ ID NO: 2716 - protein, 15 aa, Homo sapiens
YLAWQAGMDMCSAGW

SEQ ID NO: 2717 - protein, 7 aa, Homo sapiens
YNSTYRV

SEQ ID NO: 2718 - protein, 7 aa, Homo sapiens
YRVVSVL

SEQ ID NO: 2719 - protein, 7 aa, Homo sapiens
YVDGVQV

SEQ ID NO: 2720 - protein, 9 aa, Human herpesvirus
AARQRLQDI

SEQ ID NO: 2721 - protein, 13 aa, Homo sapiens
AGWLADGSLRYPI

SEQ ID NO: 2722 - protein, 13 aa, Homo sapiens
AGWLADQTVRYPI

SEQ ID NO: 2723 - protein, 14 aa, Homo sapiens
ARGAQGPPGATGFP

SEQ ID NO: 2724 - protein, 18 aa, Homo sapiens
ATLEVQSLRSNDSGVYRC

SEQ ID NO: 2725 - protein, 10 aa, Unknown
  epitope involved in rheumatoid arthritis
AWNCCVKQTP

SEQ ID NO: 2726 - protein, 20 aa, Mycobacterium tuberculosis
AYDEEARRGLERGLNALADA

SEQ ID NO: 2727 - protein, 9 aa, Human herpesvirus
CLGGLLTMN

SEQ ID NO: 2728 - protein, 7 aa, Homo sapiens
CSVMHEG

SEQ ID NO: 2729 - protein, 11 aa, Homo sapiens
DAGPQGKVGPS

SEQ ID NO: 2730 - protein, 7 aa, Homo sapiens
DGSFFLY

SEQ ID NO: 2731 - protein, 18 aa, Homo sapiens
DSGHRGYSGSQASDNEGH

SEQ ID NO: 2732 - protein, 9 aa, Porphyromonas gingivalis
DSRGNPTVE

SEQ ID NO: 2733 - protein, 7 aa, Homo sapiens
EGLHNHY

SEQ ID NO: 2734 - protein, 11 aa, Homo sapiens
ERGLKGHRGFT

SEQ ID NO: 2735 - protein, 11 aa, Homo sapiens
GGQGSRHQQAR

SEQ ID NO: 2736 - protein, 14 aa, Homo sapiens
GGVGPIGPPGERGA

SEQ ID NO: 2737 - protein, 9 aa, Bos taurus
GPAGPAGER

SEQ ID NO: 2738 - protein, 9 aa, Human herpesvirus
GPKVKRPPI

SEQ ID NO: 2739 - protein, 11 aa, Unknown
  epitope involved in rheumatoid arthritis
GWVAMHPQGDL

SEQ ID NO: 2740 - protein, 21 aa, Homo sapiens
HQCHQESTRGRSRGRCGRSGS

SEQ ID NO: 2741 - protein, 18 aa, Homo sapiens
HSASQDGQDTIRGHPGSS

SEQ ID NO: 2742 - protein, 22 aa, Homo sapiens
HSGIGHGQASSAVRDSGHRGYS

SEQ ID NO: 2743 - protein, 17 aa, Homo sapiens
HSTSQEGQDTIHGHRGS

SEQ ID NO: 2744 - protein, 7 aa, Homo sapiens
KSLSLSP

SEQ ID NO: 2745 - protein, 20 aa, Homo sapiens
LGLRLIYFSYDVKMKEKGDI

SEQ ID NO: 2746 - protein, 10 aa, Unknown
  epitope involved in rheumatoid arthritis
LGWMRYHPQA

SEQ ID NO: 2747 - protein, 10 aa, Human herpesvirus
LLDFVRFMGY

SEQ ID NO: 2748 - protein, 10 aa, Unknown
  epitope involved in rheumatoid arthritis
LLPWLDGHPM

SEQ ID NO: 2749 - protein, 10 aa, Homo sapiens
LLRGYHQDAY

SEQ ID NO: 2750 - protein, 11 aa, Homo sapiens
LVGPRGERGFP

SEQ ID NO: 2751 - protein, 10 aa, Unknown
  epitope involved in rheumatoid arthritis
NWLSLITAAR

SEQ ID NO: 2752 - protein, 13 aa, Homo sapiens
PEFSGLPSGIAEV

SEQ ID NO: 2753 - protein, 15 aa, Mus musculus
PPGANGNPGPAGPPG

SEQ ID NO: 2754 - protein, 9 aa, Homo sapiens
PPGPTGASG

SEQ ID NO: 2755 - protein, 7 aa, Homo sapiens
PQVYTLP

SEQ ID NO: 2756 - protein, 7 aa, Homo sapiens
PREPQVY

SEQ ID NO: 2757 - protein, 11 aa, Homo sapiens
QGKVGPSGAPG

SEQ ID NO: 2758 - protein, 9 aa, Human herpesvirus
QLLQHYREV

SEQ ID NO: 2759 - protein, 18 aa, Homo sapiens
RGFTGLQGLPGPPGPSGD

SEQ ID NO: 2760 - protein, 9 aa, Unknown
  epitope involved in rheumatoid arthritis
RRLPFGSQM

SEQ ID NO: 2761 - protein, 15 aa, Homo sapiens
RVAEQLRAYLEGECV

SEQ ID NO: 2762 - protein, 19 aa, Homo sapiens
SGFQGLPGPPGPPGEGGGK

SEQ ID NO: 2763 - protein, 19 aa, Homo sapiens
SHQESTRGRSRGRSGRSGS

SEQ ID NO: 2764 - protein, 10 aa, Unknown
  epitope involved in rheumatoid arthritis
SIFFAVVLEL

SEQ ID NO: 2765 - protein, 10 aa, Unknown
  epitope involved in rheumatoid arthritis
SLCINLRAAR

SEQ ID NO: 2766 - protein, 11 aa, Unknown
  epitope involved in rheumatoid arthritis
SLITAARGAPS

SEQ ID NO: 2767 - protein, 17 aa, Homo sapiens
SMNVEVTDKGDVPEGYK

SEQ ID NO: 2768 - protein, 17 aa, Homo sapiens
SQIVNDFQKGDIAEGYS

SEQ ID NO: 2769 - protein, 10 aa, Unknown
  epitope involved in rheumatoid arthritis
VDLMTIRSCR

SEQ ID NO: 2770 - protein, 9 aa, Human herpesvirus
VMATLLPPV

SEQ ID NO: 2771 - protein, 13 aa, Homo sapiens
WDRETQICKAKAQ

SEQ ID NO: 2772 - protein, 10 aa, Unknown
  epitope involved in rheumatoid arthritis
WFTSWERDWW

SEQ ID NO: 2773 - protein, 10 aa, Unknown
  epitope involved in rheumatoid arthritis
WPPSFWYHPQ

SEQ ID NO: 2774 - protein, 10 aa, Unknown
  epitope involved in rheumatoid arthritis
WVAMHPQGDL

SEQ ID NO: 2775 - protein, 10 aa, Unknown
  epitope involved in rheumatoid arthritis
WWATFFEATR

SEQ ID NO: 2776 - protein, 10 aa, Unknown
  epitope involved in rheumatoid arthritis
WWNMFQMGVV

SEQ ID NO: 2777 - protein, 9 aa, Unknown
  epitope involved in rheumatoid arthritis
AAFSELPLG

SEQ ID NO: 2778 - protein, 9 aa, Unknown
  epitope involved in rheumatoid arthritis
ADASVPVMP

SEQ ID NO: 2779 - protein, 15 aa, Bos taurus
AGFKGEQGPKGEPGP

SEQ ID NO: 2780 - protein, 18 aa, Homo sapiens
AGFKGEQGPKGEPGPAGP

SEQ ID NO: 2781 - protein, 18 aa, Homo sapiens
AGFKGEQGPKGEPGPAGP

SEQ ID NO: 2782 - protein, 9 aa, Unknown
  epitope involved in rheumatoid arthritis
AKYSNQRAQ

SEQ ID NO: 2783 - protein, 9 aa, Unknown
  epitope involved in rheumatoid arthritis
ALARLMPGS

SEQ ID NO: 2784 - protein, 9 aa, Unknown
  epitope involved in rheumatoid arthritis
APRRLFDIA

SEQ ID NO: 2785 - protein, 9 aa, Unknown
  epitope involved in rheumatoid arthritis
APSSLAGNG

SEQ ID NO: 2786 - protein, 9 aa, Unknown
  epitope involved in rheumatoid arthritis
AQAYDLSPS

SEQ ID NO: 2787 - protein, 9 aa, Unknown
  epitope involved in rheumatoid arthritis
AQSAITACW

SEQ ID NO: 2788 - protein, 9 aa, Unknown
  epitope involved in rheumatoid arthritis
ASKAKARPV

SEQ ID NO: 2789 - protein, 9 aa, Unknown
  epitope involved in rheumatoid arthritis
ATADYPQKS

SEQ ID NO: 2790 - protein, 9 aa, Unknown
  epitope involved in rheumatoid arthritis
ATNIFIEGT

SEQ ID NO: 2791 - protein, 9 aa, Unknown
  epitope involved in rheumatoid arthritis
CTRHPDCQA

SEQ ID NO: 2792 - protein, 16 aa, Homo sapiens
DDTQFVRFDSDAASPR

SEQ ID NO: 2793 - protein, 16 aa, Homo sapiens
DLRSWTAADTAAQITQ

SEQ ID NO: 2794 - protein, 17 aa, Homo sapiens
DLSSWTAADTAAQITQR

SEQ ID NO: 2795 - protein, 15 aa, Homo sapiens
DNPEYSPDPSIYAYD

SEQ ID NO: 2796 - protein, 18 aa, Bos taurus
EPGIAGFKGEQGPKGEPG

SEQ ID NO: 2797 - protein, 9 aa, Unknown
  epitope involved in rheumatoid arthritis
EQAQSQTLP

SEQ ID NO: 2798 - protein, 9 aa, Unknown
  epitope involved in rheumatoid arthritis
EVAHPSVPL

SEQ ID NO: 2799 - protein, 15 aa, Homo sapiens
FEDMAKSDKARYDRE

SEQ ID NO: 2800 - protein, 17 aa, Homo sapiens
FLAEGGGVRGPRVVERH

SEQ ID NO: 2801 - protein, 12 aa, Homo sapiens
FVRFDSDAASPR

SEQ ID NO: 2802 - protein, 11 aa, Homo sapiens
FVRFDSDAASQ

SEQ ID NO: 2803 - protein, 13 aa, Homo sapiens
FVRFDSDAASQRM

SEQ ID NO: 2804 - protein, 9 aa, Unknown
  epitope involved in rheumatoid arthritis
GASGDIAKQ

SEQ ID NO: 2805 - protein, 9 aa, Unknown
  epitope involved in rheumatoid arthritis
GGETLLHMA

SEQ ID NO: 2806 - protein, 15 aa, Homo sapiens
GIAGFKGEQGPKGEP

SEQ ID NO: 2807 - protein, 15 aa, Homo sapiens
GIAGFKGEQGPKGEP

SEQ ID NO: 2808 - protein, 15 aa, Rattus norvegicus
GIAGFKGEQGPKGET

SEQ ID NO: 2809 - protein, 15 aa, Bos taurus
GPEGAQGPRGEPGTP

SEQ ID NO: 2810 - protein, 9 aa, Unknown
  epitope involved in rheumatoid arthritis
GPPRRLIDT

SEQ ID NO: 2811 - protein, 9 aa, Unknown
  epitope involved in rheumatoid arthritis
GRTPEDNTL

SEQ ID NO: 2812 - protein, 9 aa, Unknown
  epitope involved in rheumatoid arthritis
GWPVAPDPA

SEQ ID NO: 2813 - protein, 9 aa, Unknown
  epitope involved in rheumatoid arthritis
HAKKTPPAS

SEQ ID NO: 2814 - protein, 9 aa, Unknown
  epitope involved in rheumatoid arthritis
HELGDIAIA

SEQ ID NO: 2815 - protein, 9 aa, Unknown
  epitope involved in rheumatoid arthritis
HLRQGRNTA

SEQ ID NO: 2816 - protein, 21 aa, Unknown
  epitope involved in rheumatoid arthritis
HQCHQESTRGRSRGRCGRSGS

SEQ ID NO: 2817 - protein, 9 aa, Unknown
  epitope involved in rheumatoid arthritis
IRRSETPRA

SEQ ID NO: 2818 - protein, 9 aa, Unknown
  epitope involved in rheumatoid arthritis
IRYHTNWSS

SEQ ID NO: 2819 - protein, 19 aa, Homo sapiens
IYFRNQKGHSGLQPTGFLS

SEQ ID NO: 2820 - protein, 19 aa, Homo sapiens
IYFRNQKGHSGLQPTGLLS

SEQ ID NO: 2821 - protein, 15 aa, Homo sapiens
KEKSKFEDMAKSDKA

SEQ ID NO: 2822 - protein, 15 aa, Homo sapiens
KHKVYACEVTHQGLS

SEQ ID NO: 2823 - protein, 16 aa, Homo sapiens
KIHAREIFDSRGNPTV

SEQ ID NO: 2824 - protein, 15 aa, Homo sapiens
KKGKKKDPNAPKRPP

SEQ ID NO: 2825 - protein, 9 aa, Unknown
  epitope involved in rheumatoid arthritis
KMPIEADPL

SEQ ID NO: 2826 - protein, 15 aa, Homo sapiens
KSDKARYDREMKNYV

SEQ ID NO: 2827 - protein, 9 aa, Unknown
  epitope involved in rheumatoid arthritis
KSGPIDIIG

SEQ ID NO: 2828 - protein, 15 aa, Homo sapiens
KTMSAKEKSKFEDMA

SEQ ID NO: 2829 - protein, 9 aa, Unknown
  epitope involved in rheumatoid arthritis
LGLHALQSP

SEQ ID NO: 2830 - protein, 9 aa, Unknown
  epitope involved in rheumatoid arthritis
LGRDANAWK

SEQ ID NO: 2831 - protein, 9 aa, Unknown
  epitope involved in rheumatoid arthritis
LLRPVARDT

SEQ ID NO: 2832 - protein, 9 aa, Unknown
  epitope involved in rheumatoid arthritis
LNTAKHRES

SEQ ID NO: 2833 - protein, 13 aa, Homo sapiens
LPSYEEALSLPSK

SEQ ID NO: 2834 - protein, 9 aa, Unknown
  epitope involved in rheumatoid arthritis
LSRASLKTL

SEQ ID NO: 2835 - protein, 15 aa, Homo sapiens
LSSWTAADTAAQITQ

SEQ ID NO: 2836 - protein, 9 aa, Unknown
  epitope involved in rheumatoid arthritis
LVGTPQKTK

SEQ ID NO: 2837 - protein, 15 aa, Homo sapiens
MKNYVPPKGDKKGKK

SEQ ID NO: 2838 - protein, 9 aa, Unknown
  epitope involved in rheumatoid arthritis
NKALTFFLP

SEQ ID NO: 2839 - protein, 9 aa, Unknown
  epitope involved in rheumatoid arthritis
NLFTQTGTP

SEQ ID NO: 2840 - protein, 9 aa, Unknown
  epitope involved in rheumatoid arthritis
NNSFEKVKQ

SEQ ID NO: 2841 - protein, 9 aa, Unknown
  epitope involved in rheumatoid arthritis
NSSPYLNTK

SEQ ID NO: 2842 - protein, 9 aa, Unknown
  epitope involved in rheumatoid arthritis
PDHLPRHVS

SEQ ID NO: 2843 - protein, 9 aa, Unknown
  epitope involved in rheumatoid arthritis
PEIIENFDP

SEQ ID NO: 2844 - protein, 9 aa, Unknown
  epitope involved in rheumatoid arthritis
PLTNRRLRG

SEQ ID NO: 2845 - protein, 15 aa, Homo sapiens
PPKGDKKGKKKDPNA

SEQ ID NO: 2846 - protein, 9 aa, Unknown
  epitope involved in rheumatoid arthritis
PPLLLTDVT

SEQ ID NO: 2847 - protein, 9 aa, Unknown
  epitope involved in rheumatoid arthritis
PQSPGSSFP

SEQ ID NO: 2848 - protein, 9 aa, Unknown
  epitope involved in rheumatoid arthritis
PSFPPALRL

SEQ ID NO: 2849 - protein, 9 aa, Unknown
  epitope involved in rheumatoid arthritis
PVSSTRGNM

SEQ ID NO: 2850 - protein, 9 aa, Unknown
  epitope involved in rheumatoid arthritis
PYPFAQKRL

SEQ ID NO: 2851 - protein, 9 aa, Unknown
  epitope involved in rheumatoid arthritis
QSPRLYPGS

SEQ ID NO: 2852 - protein, 9 aa, Unknown
  epitope involved in rheumatoid arthritis
RGGIRRQSL

SEQ ID NO: 2853 - protein, 9 aa, Unknown
  epitope involved in rheumatoid arthritis
RKALRLSAS

SEQ ID NO: 2854 - protein, 9 aa, Unknown
  epitope involved in rheumatoid arthritis
RPPHSASWR

SEQ ID NO: 2855 - protein, 9 aa, Unknown
  epitope involved in rheumatoid arthritis
RRGPEAHQA

SEQ ID NO: 2856 - protein, 9 aa, Unknown
  epitope involved in rheumatoid arthritis
RRRVRNSDT

SEQ ID NO: 2857 - protein, 15 aa, Homo sapiens
RYDREMKNYVPPKGD

SEQ ID NO: 2858 - protein, 9 aa, Unknown
  epitope involved in rheumatoid arthritis
SESTIQNLR

SEQ ID NO: 2859 - protein, 14 aa, Homo sapiens
SHQESTRGRSRGRS

SEQ ID NO: 2860 - protein, 19 aa, Homo sapiens
SHQESTRGRSRGRSGRSGS

SEQ ID NO: 2861 - protein, 19 aa, Homo sapiens
SHQESTRGRSRGRSGRSGS

SEQ ID NO: 2862 - protein, 19 aa, Homo sapiens
SHQESTRGRSRGRSGRSGS

SEQ ID NO: 2863 - protein, 19 aa, Homo sapiens
SHQESTRGRSRGRSGRSGS

SEQ ID NO: 2864 - protein, 19 aa, Homo sapiens
SHQESTRGRSRGRSGRSGS

SEQ ID NO: 2865 - protein, 19 aa, Homo sapiens
SHQESTRGRSRGRSGRSGS

SEQ ID NO: 2866 - protein, 19 aa, Homo sapiens
SHQESTRGRSRGRSGRSGS

SEQ ID NO: 2867 - protein, 19 aa, Homo sapiens
SHQESTRGRSRGRSGRSGS

SEQ ID NO: 2868 - protein, 9 aa, Unknown
  epitope involved in rheumatoid arthritis
STLVPNKAP

SEQ ID NO: 2869 - protein, 16 aa, Homo sapiens
STRSVSSSSYRRMFGG

SEQ ID NO: 2870 - protein, 9 aa, Unknown
  epitope involved in rheumatoid arthritis
TFRDLHQQQ

SEQ ID NO: 2871 - protein, 14 aa, Homo sapiens
TGPSTRGRQGSRHE

SEQ ID NO: 2872 - protein, 17 aa, Homo sapiens
TGPSTRGRQGSRHEQAQ

SEQ ID NO: 2873 - protein, 17 aa, Homo sapiens
TGPSTRGRQGSRHEQAQ

SEQ ID NO: 2874 - protein, 18 aa, Homo sapiens
TIHAHPGSRRGGRHGYHH

SEQ ID NO: 2875 - protein, 10 aa, Unknown
  epitope involved in rheumatoid arthritis
TLTFTLNKLR

SEQ ID NO: 2876 - protein, 9 aa, Unknown
  epitope involved in rheumatoid arthritis
TPDSLGRPS

SEQ ID NO: 2877 - protein, 17 aa, Homo sapiens
VDDTQFVRFDSDAASPR

SEQ ID NO: 2878 - protein, 21 aa, Homo sapiens
VDDTQFVRFDSDAASPRGEPR

SEQ ID NO: 2879 - protein, 9 aa, Unknown
  epitope involved in rheumatoid arthritis
VPVDAGTAK

SEQ ID NO: 2880 - protein, 9 aa, Unknown
  epitope involved in rheumatoid arthritis
YKLRRAYYA

SEQ ID NO: 2881 - protein, 9 aa, Unknown
  epitope involved in rheumatoid arthritis
YTLQKAVLS

SEQ ID NO: 2882 - protein, 11 aa, Rattus norvegicus
ARGLTGRPGDA

SEQ ID NO: 2883 - protein, 16 aa, Homo sapiens
CKPISGHNSLFWYRQT

SEQ ID NO: 2884 - protein, 16 aa, Homo sapiens
DAGVIQSPRHEVTEMG

SEQ ID NO: 2885 - protein, 7 aa, Homo sapiens
DELTKNQ

SEQ ID NO: 2886 - protein, 7 aa, Homo sapiens
DKSRWQE

SEQ ID NO: 2887 - protein, 10 aa, Homo sapiens
DPISGHVSLF

SEQ ID NO: 2888 - protein, 7 aa, Homo sapiens
DSDGSFF

SEQ ID NO: 2889 - protein, 10 aa, Homo sapiens
EALHNHYQKS

SEQ ID NO: 2890 - protein, 7 aa, Homo sapiens
EGNVFSC

SEQ ID NO: 2891 - protein, 7 aa, Homo sapiens
ENYKTTP

SEQ ID NO: 2892 - protein, 7 aa, Homo sapiens
EPQVYTL

SEQ ID NO: 2893 - protein, 7 aa, Homo sapiens
EWGSNDG

SEQ ID NO: 2894 - protein, 7 aa, Homo sapiens
FFLYSKL

SEQ ID NO: 2895 - protein, 7 aa, Homo sapiens
FLYSKLT

SEQ ID NO: 2896 - protein, 15 aa, Bos taurus
GERGSPGAVGPKGSP

SEQ ID NO: 2897 - protein, 7 aa, Homo sapiens
GLHNHYT

SEQ ID NO: 2898 - protein, 7 aa, Homo sapiens
GNVFSCS

SEQ ID NO: 2899 - protein, 15 aa, Bos taurus
GPTGARGPEGAQGPR

SEQ ID NO: 2900 - protein, 7 aa, Homo sapiens
GQPREPQ

SEQ ID NO: 2901 - protein, 15 aa, Bos taurus
GSAGAPGIAGAPGFP

SEQ ID NO: 2902 - protein, 7 aa, Homo sapiens
GSFFLYS

SEQ ID NO: 2903 - protein, 7 aa, Homo sapiens
HEGLHNH

SEQ ID NO: 2904 - protein, 8 aa, Rattus norvegicus
IAGFKGEQ

SEQ ID NO: 2905 - protein, 16 aa, Homo sapiens
KIQPSEPRDSAVYFCA

SEQ ID NO: 2906 - protein, 7 aa, Homo sapiens
KNQVSLT

SEQ ID NO: 2907 - protein, 10 aa, Homo sapiens
KPISGHNSLF

SEQ ID NO: 2908 - protein, 7 aa, Homo sapiens
KSRWQEG

SEQ ID NO: 2909 - protein, 7 aa, Homo sapiens
LDSDGSF

SEQ ID NO: 2910 - protein, 7 aa, Homo sapiens
LHNHYTQ

SEQ ID NO: 2911 - protein, 7 aa, Homo sapiens
LTKNQVS

SEQ ID NO: 2912 - protein, 11 aa, Homo sapiens
LVGPRGERGFP

SEQ ID NO: 2913 - protein, 7 aa, Homo sapiens
MHEGLHN

SEQ ID NO: 2914 - protein, 14 aa, Rattus norvegicus
MPGERGAAGIAGPK

SEQ ID NO: 2915 - protein, 7 aa, Homo sapiens
NQVSLTC

SEQ ID NO: 2916 - protein, 7 aa, Homo sapiens
NVFSCSV

SEQ ID NO: 2917 - protein, 7 aa, Homo sapiens
NYKTTPP

SEQ ID NO: 2918 - protein, 7 aa, Homo sapiens
PPSRDEL

SEQ ID NO: 2919 - protein, 7 aa, Homo sapiens
PPSREEM

SEQ ID NO: 2920 - protein, 7 aa, Homo sapiens
PSRDELT

SEQ ID NO: 2921 - protein, 7 aa, Homo sapiens
PSREEMT

SEQ ID NO: 2922 - protein, 7 aa, Homo sapiens
QKSLSLS

SEQ ID NO: 2923 - protein, 16 aa, Homo sapiens
QPLKEQPALNDSRYCL

SEQ ID NO: 2924 - protein, 7 aa, Homo sapiens
QPREPQV

SEQ ID NO: 2925 - protein, 7 aa, Homo sapiens
QVSLTCL

SEQ ID NO: 2926 - protein, 7 aa, Homo sapiens
QVYTLPP

SEQ ID NO: 2927 - protein, 7 aa, Homo sapiens
REPQVYT

SEQ ID NO: 2928 - protein, 21 aa, Mus musculus
RGFGFVTFSSMAEVDAAMAAR

SEQ ID NO: 2929 - protein, 11 aa, Homo sapiens
RSLDFQATTMF

SEQ ID NO: 2930 - protein, 7 aa, Homo sapiens
RWQEGNV

SEQ ID NO: 2931 - protein, 16 aa, Homo sapiens
SATFWQNPRNHFRCQV

SEQ ID NO: 2932 - protein, 7 aa, Homo sapiens
SCSVMHE

SEQ ID NO: 2933 - protein, 7 aa, Homo sapiens
SDGSFFL

SEQ ID NO: 2934 - protein, 7 aa, Homo sapiens
SFFLYSK

SEQ ID NO: 2935 - protein, 27 aa, Mus musculus
SGKPGAHVTVKKLFVGGIKEDTEEHHL

SEQ ID NO: 2936 - protein, 19 aa, Homo sapiens
SHQESTRGRSRGRSGRSGS

SEQ ID NO: 2937 - protein, 7 aa, Homo sapiens
SLSLSPG

SEQ ID NO: 2938 - protein, 7 aa, Homo sapiens
SLTCLVK

SEQ ID NO: 2939 - protein, 10 aa, Homo sapiens
SPRSGDLSVY

SEQ ID NO: 2940 - protein, 7 aa, Homo sapiens
SREEMTK

SEQ ID NO: 2941 - protein, 7 aa, Homo sapiens
SRWQEGN

SEQ ID NO: 2942 - protein, 16 aa, Homo sapiens
SRYCLSSRLRVSATFW

SEQ ID NO: 2943 - protein, 7 aa, Homo sapiens
SVMHEGL

SEQ ID NO: 2944 - protein, 7 aa, Homo sapiens
TKNQVSL

SEQ ID NO: 2945 - protein, 7 aa, Homo sapiens
TLPPSRE

SEQ ID NO: 2946 - protein, 7 aa, Homo sapiens
VEWGSND

SEQ ID NO: 2947 - protein, 7 aa, Homo sapiens
VFSCSVM

SEQ ID NO: 2948 - protein, 7 aa, Homo sapiens
VMHEGLH

SEQ ID NO: 2949 - protein, 7 aa, Homo sapiens
VSLTCLV

SEQ ID NO: 2950 - protein, 16 aa, Homo sapiens
VYFCASSFSTCSANYG

SEQ ID NO: 2951 - protein, 7 aa, Homo sapiens
VYTLPPS

SEQ ID NO: 2952 - protein, 7 aa, Homo sapiens
WQEGNVF

SEQ ID NO: 2953 - protein, 15 aa, Homo sapiens
GIAGAPGFPGPRGPP

SEQ ID NO: 2954 - protein, 15 aa, Homo sapiens
GIPGAKGSAGAPGIA

SEQ ID NO: 2955 - protein, 20 aa, Homo sapiens
ARGHRPLDKKREEAPSLRPA

SEQ ID NO: 2956 - protein, 20 aa, Homo sapiens
ARGHRPLDKKREEAPSLRPA

SEQ ID NO: 2957 - protein, 20 aa, Homo sapiens
ARGHRPLDKKREEAPSLRPA

SEQ ID NO: 2958 - protein, 20 aa, Homo sapiens
ARGHRPLDKKREEAPSLRPA

SEQ ID NO: 2959 - protein, 20 aa, Homo sapiens
ARGHRPLDKKREEAPSLRPA

SEQ ID NO: 2960 - protein, 20 aa, Homo sapiens
ARGHRPLDKKREEAPSLRPA

SEQ ID NO: 2961 - protein, 20 aa, Homo sapiens
ARGHRPLDKKREEAPSLRPA

SEQ ID NO: 2962 - protein, 20 aa, Homo sapiens
ARGHRPLDKKREEAPSLRPA

SEQ ID NO: 2963 - protein, 20 aa, Homo sapiens
ARGHRPLDKKREEAPSLRPA

SEQ ID NO: 2964 - protein, 20 aa, Homo sapiens
ARGHRPLDKKREEAPSLRPA

SEQ ID NO: 2965 - protein, 20 aa, Homo sapiens
ARGHRPLDKKREEAPSLRPA

SEQ ID NO: 2966 - protein, 20 aa, Homo sapiens
ARGHRPLDKKREEAPSLRPA

SEQ ID NO: 2967 - protein, 20 aa, Homo sapiens
ARGHRPLDKKREEAPSLRPA

SEQ ID NO: 2968 - protein, 20 aa, Homo sapiens
ARGHRPLDKKREEAPSLRPA

SEQ ID NO: 2969 - protein, 20 aa, Homo sapiens
ARGHRPLDKKREEAPSLRPA

SEQ ID NO: 2970 - protein, 20 aa, Homo sapiens
ARGHRPLDKKREEAPSLRPA

SEQ ID NO: 2971 - protein, 21 aa, Unknown
  epitope involved in rheumatoid arthritis
ARGHRPLDKKREEAPSLRPAD

SEQ ID NO: 2972 - protein, 38 aa, Unknown
  epitope involved in rheumatoid arthritis
ARGHRPLDKKREEAPSLRPAGGGHSTKRGHAKSRPVRG

SEQ ID NO: 2973 - protein, 18 aa, Homo sapiens
FFSARGHRPLDKKREEAP

SEQ ID NO: 2974 - protein, 18 aa, Homo sapiens
FFSARGHRPLDKKREEAP

SEQ ID NO: 2975 - protein, 18 aa, Homo sapiens
FFSARGHRPLDKKREEAP

SEQ ID NO: 2976 - protein, 18 aa, Homo sapiens
FFSARGHRPLDKKREEAP

SEQ ID NO: 2977 - protein, 18 aa, Homo sapiens
FFSARGHRPLDKKREEAP

SEQ ID NO: 2978 - protein, 18 aa, Homo sapiens
FFSARGHRPLDKKREEAP

SEQ ID NO: 2979 - protein, 18 aa, Homo sapiens
FFSARGHRPLDKKREEAP

SEQ ID NO: 2980 - protein, 18 aa, Homo sapiens
FFSARGHRPLDKKREEAP

SEQ ID NO: 2981 - protein, 24 aa, Unknown
  epitope involved in rheumatoid arthritis
GFFCARGHRPLDKKREEAPCLRPA

SEQ ID NO: 2982 - protein, 18 aa, Homo sapiens
GNVSPGTRREYHTEKLVT

SEQ ID NO: 2983 - protein, 18 aa, Homo sapiens
GNVSPGTRREYHTEKLVT

SEQ ID NO: 2984 - protein, 18 aa, Homo sapiens
GNVSPGTRREYHTEKLVT

SEQ ID NO: 2985 - protein, 21 aa, Unknown [sequence omitted]

SEQ ID NO: 2986 - protein, 15 aa, Homo sapiens
HSTKRGHAKSRPVRG

SEQ ID NO: 2987 - protein, 15 aa, Homo sapiens
HSTKRGHAKSRPVRG

SEQ ID NO: 2988 - protein, 15 aa, Homo sapiens
HSTKRGHAKSRPVRG

SEQ ID NO: 2989 - protein, 15 aa, Homo sapiens
HSTKRGHAKSRPVRG

SEQ ID NO: 2990 - protein, 15 aa, Homo sapiens
HSTKRGHAKSRPVRG

SEQ ID NO: 2991 - protein, 15 aa, Homo sapiens
HSTKRGHAKSRPVRG

SEQ ID NO: 2992 - protein, 15 aa, Homo sapiens
HSTKRGHAKSRPVRG

SEQ ID NO: 2993 - protein, 15 aa, Homo sapiens
HSTKRGHAKSRPVRG

SEQ ID NO: 2994 - protein, 36 aa, Unknown
  epitope involved in rheumatoid arthritis
HSTKRGHAKSRPVRGHQCHQESTRGRSRGRCGRSGS

SEQ ID NO: 2995 - protein, 18 aa, Homo sapiens
IAKDLLPSRDRQHLPLIK

SEQ ID NO: 2996 - protein, 18 aa, Homo sapiens
IAKDLLPSRDRQHLPLIK

SEQ ID NO: 2997 - protein, 18 aa, Homo sapiens
IAKDLLPSRDRQHLPLIK

SEQ ID NO: 2998 - protein, 18 aa, Homo sapiens
IAKDLLPSRDRQHLPLIK

SEQ ID NO: 2999 - protein, 22 aa, Mus musculus
QTLDHNTMYWYKQDSKKLLKIM

SEQ ID NO: 3000 - protein, 18 aa, Homo sapiens
RARPAKAAATQKKVERKA

SEQ ID NO: 3001 - protein, 18 aa, Homo sapiens
RARPAKAAATQKKVERKA

SEQ ID NO: 3002 - protein, 18 aa, Homo sapiens
RARPAKAAATQKKVERKA

SEQ ID NO: 3003 - protein, 18 aa, Homo sapiens
RARPAKAAATQKKVERKA

SEQ ID NO: 3004 - protein, 18 aa, Homo sapiens
RARPAKAAATQKKVERKA

SEQ ID NO: 3005 - protein, 18 aa, Homo sapiens
RARPAKAAATQKKVERKA

SEQ ID NO: 3006 - protein, 18 aa, Homo sapiens
SGIGTLDGFRHRHPDEAA

SEQ ID NO: 3007 - protein, 18 aa, Homo sapiens
SGIGTLDGFRHRHPDEAA

SEQ ID NO: 3008 - protein, 18 aa, Homo sapiens
SRALAREVDLKDYEDQQK

SEQ ID NO: 3009 - protein, 18 aa, Homo sapiens
SRALAREVDLKDYEDQQK

SEQ ID NO: 3010 - protein, 18 aa, Homo sapiens
SRALAREVDLKDYEDQQK

SEQ ID NO: 3011 - protein, 15 aa, Homo sapiens
GNPGTDGIPGAKGSA

SEQ ID NO: 3012 - protein, 15 aa, Homo sapiens
GPAGASGNPGTDGIP

SEQ ID NO: 3013 - protein, 15 aa, Homo sapiens
GPRGEPGTPGSPGPA

SEQ ID NO: 3014 - protein, 15 aa, Homo sapiens
GTPGSPGPAGASGNP

SEQ ID NO: 3015 - protein, 7 aa, Homo sapiens
AGEKVTM

SEQ ID NO: 3016 - protein, 7 aa, Homo sapiens
AHIWWND

SEQ ID NO: 3017 - protein, 7 aa, Homo sapiens
ARMRDGA

SEQ ID NO: 3018 - protein, 7 aa, Homo sapiens
ASTRESG

SEQ ID NO: 3019 - protein, 7 aa, Homo sapiens
AVYFCHQ

SEQ ID NO: 3020 - protein, 7 aa, Homo sapiens
AWFAYWG

SEQ ID NO: 3021 - protein, 7 aa, Homo sapiens
AYWGQGT

SEQ ID NO: 3022 - protein, 7 aa, Homo sapiens
CARMRDG

SEQ ID NO: 3023 - protein, 7 aa, Homo sapiens
CHQYLSS

SEQ ID NO: 3024 - protein, 7 aa, Homo sapiens
CSFSGFS

SEQ ID NO: 3025 - protein, 7 aa, Homo sapiens
DGAWFAY

SEQ ID NO: 3026 - protein, 7 aa, Homo sapiens
DHKNYLA

SEQ ID NO: 3027 - protein, 7 aa, Homo sapiens
DLAVYFC

SEQ ID NO: 3028 - protein, 7 aa, Homo sapiens
EDLAVYF

SEQ ID NO: 3029 - protein, 7 aa, Homo sapiens
ESGVPDR

SEQ ID NO: 3030 - protein, 7 aa, Homo sapiens
EWLAHIW

SEQ ID NO: 3031 - protein, 7 aa, Homo sapiens
FAYWGQG

SEQ ID NO: 3032 - protein, 7 aa, Homo sapiens
FCHQYLS

SEQ ID NO: 3033 - protein, 7 aa, Homo sapiens
FSGFSLT

SEQ ID NO: 3034 - protein, 7 aa, Homo sapiens
FSLTTYG

SEQ ID NO: 3035 - protein, 7 aa, Homo sapiens
FYNTVLK

SEQ ID NO: 3036 - protein, 7 aa, Homo sapiens
GAWFAYW

SEQ ID NO: 3037 - protein, 7 aa, Homo sapiens
GFSLTTY

SEQ ID NO: 3038 - protein, 7 aa, Homo sapiens
GIGVGWI

SEQ ID NO: 3039 - protein, 7 aa, Homo sapiens
GKGLEWL

SEQ ID NO: 3040 - protein, 7 aa, Homo sapiens
GLEWLAH

SEQ ID NO: 3041 - protein, 15 aa, Bos taurus
GPAGPAGTAGARGAP

SEQ ID NO: 3042 - protein, 7 aa, Homo sapiens
GQSPKLL

SEQ ID NO: 3043 - protein, 7 aa, Homo sapiens
GSGSGTD

SEQ ID NO: 3044 - protein, 7 aa, Homo sapiens
GSGTDFT

SEQ ID NO: 3045 - protein, 7 aa, Homo sapiens
GVGWIRQ

SEQ ID NO: 3046 - protein, 7 aa, Homo sapiens
GVPDRFT

SEQ ID NO: 3047 - protein, 7 aa, Homo sapiens
GWIRQRS

SEQ ID NO: 3048 - protein, 7 aa, Homo sapiens
HIWWNDN

SEQ ID NO: 3049 - protein, 7 aa, Homo sapiens
HQYLSSF

SEQ ID NO: 3050 - protein, 7 aa, Homo sapiens
IGVGWIR

SEQ ID NO: 3051 - protein, 7 aa, Homo sapiens
IRQRSGK

SEQ ID NO: 3052 - protein, 7 aa, Homo sapiens
IWWNDNK

SEQ ID NO: 3053 - protein, 7 aa, Homo sapiens
KGLEWLA

SEQ ID NO: 3054 - protein, 7 aa, Homo sapiens
KLLIYWA

SEQ ID NO: 3055 - protein, 7 aa, Homo sapiens
KNYLAWY

SEQ ID NO: 3056 - protein, 7 aa, Homo sapiens
KVTMTCK

SEQ ID NO: 3057 - protein, 7 aa, Homo sapiens
LAHIWWN

SEQ ID NO: 3058 - protein, 7 aa, Homo sapiens
LAVYFCH

SEQ ID NO: 3059 - protein, 7 aa, Homo sapiens
LEWLAHI

SEQ ID NO: 3060 - protein, 7 aa, Homo sapiens
LIYWAST

SEQ ID NO: 3061 - protein, 7 aa, Homo sapiens
LLIYWAS

SEQ ID NO: 3062 - protein, 7 aa, Homo sapiens
LTCSFSG

SEQ ID NO: 3063 - protein, 7 aa, Homo sapiens
LYSSDHK

SEQ ID NO: 3064 - protein, 7 aa, Homo sapiens
MRDGAWF

SEQ ID NO: 3065 - protein, 7 aa, Homo sapiens
NYLAWYQ

SEQ ID NO: 3066 - protein, 7 aa, Homo sapiens
PGQSPKL

SEQ ID NO: 3067 - protein, 7 aa, Homo sapiens
PKLLIYW

SEQ ID NO: 3068 - protein, 7 aa, Homo sapiens
QSPKLLI

SEQ ID NO: 3069 - protein, 7 aa, Homo sapiens
QSVLYSS

SEQ ID NO: 3070 - protein, 7 aa, Homo sapiens
QTEDLAV

SEQ ID NO: 3071 - protein, 7 aa, Homo sapiens
QYLSSFT

SEQ ID NO: 3072 - protein, 7 aa, Homo sapiens
RDGAWFA

SEQ ID NO: 3073 - protein, 7 aa, Homo sapiens
RESGVPD

SEQ ID NO: 3074 - protein, 7 aa, Homo sapiens
RMRDGAW

SEQ ID NO: 3075 - protein, 7 aa, Homo sapiens
SAGEKVT

SEQ ID NO: 3076 - protein, 7 aa, Homo sapiens
SDHKNYL

SEQ ID NO: 3077 - protein, 7 aa, Homo sapiens
SFSGFSL

SEQ ID NO: 3078 - protein, 7 aa, Homo sapiens
SGFSLTT

SEQ ID NO: 3079 - protein, 7 aa, Homo sapiens
SGSGTDF

SEQ ID NO: 3080 - protein, 7 aa, Homo sapiens
SGVPDRF

SEQ ID NO: 3081 - protein, 7 aa, Homo sapiens
SLTTYGI

SEQ ID NO: 3082 - protein, 7 aa, Homo sapiens
SPKLLIY

SEQ ID NO: 3083 - protein, 7 aa, Homo sapiens
SQSVLYS

SEQ ID NO: 3084 - protein, 7 aa, Homo sapiens
SSQSVLY

SEQ ID NO: 3085 - protein, 7 aa, Homo sapiens
STRESGV

SEQ ID NO: 3086 - protein, 7 aa, Homo sapiens
SVLYSSD

SEQ ID NO: 3087 - protein, 7 aa, Homo sapiens
TCSFSGF

SEQ ID NO: 3088 - protein, 7 aa, Homo sapiens
TEDLAVY

SEQ ID NO: 3089 - protein, 7 aa, Homo sapiens
TGSGSGT

SEQ ID NO: 3090 - protein, 7 aa, Homo sapiens
TMTCKSS

SEQ ID NO: 3091 - protein, 7 aa, Homo sapiens
TRESGVP

SEQ ID NO: 3092 - protein, 7 aa, Homo sapiens
TTYGIGV

SEQ ID NO: 3093 - protein, 7 aa, Homo sapiens
TYGIGVG

SEQ ID NO: 3094 - protein, 7 aa, Homo sapiens
TYYCARM

SEQ ID NO: 3095 - protein, 7 aa, Homo sapiens
VGWIRQR

SEQ ID NO: 3096 - protein, 7 aa, Homo sapiens
VLYSSDH

SEQ ID NO: 3097 - protein, 7 aa, Homo sapiens
VPDRFTG

SEQ ID NO: 3098 - protein, 7 aa, Homo sapiens
VTMTCKS

SEQ ID NO: 3099 - protein, 7 aa, Homo sapiens
VYFCHQY

SEQ ID NO: 3100 - protein, 7 aa, Homo sapiens
WASTRES

SEQ ID NO: 3101 - protein, 7 aa, Homo sapiens
WFAYWGQ

SEQ ID NO: 3102 - protein, 7 aa, Homo sapiens
WIRQRSG

SEQ ID NO: 3103 - protein, 7 aa, Homo sapiens
WLAHIWW

SEQ ID NO: 3104 - protein, 7 aa, Homo sapiens
WNDNKFY

SEQ ID NO: 3105 - protein, 7 aa, Homo sapiens
WWNDNKF

SEQ ID NO: 3106 - protein, 7 aa, Homo sapiens
YCARMRD

SEQ ID NO: 3107 - protein, 7 aa, Homo sapiens
YFCHQYL

SEQ ID NO: 3108 - protein, 7 aa, Homo sapiens
YGIGVGW

SEQ ID NO: 3109 - protein, 7 aa, Homo sapiens
YLAWYQQ

SEQ ID NO: 3110 - protein, 7 aa, Homo sapiens
YLSSFTF

SEQ ID NO: 3111 - protein, 7 aa, Homo sapiens
YSSDHKN

SEQ ID NO: 3112 - protein, 7 aa, Homo sapiens
YWASTRE

SEQ ID NO: 3113 - protein, 7 aa, Homo sapiens
YYCARMR

SEQ ID NO: 3114 - protein, 16 aa, Mycobacterium tuberculosis
AILTGGQVISEEGVGL

SEQ ID NO: 3115 - protein, 16 aa, Mycobacterium tuberculosis
DRRKAMLQDMAILTGG

SEQ ID NO: 3116 - protein, 16 aa, Mycobacterium tuberculosis
DVEGEALSTLVVNKIR

SEQ ID NO: 3117 - protein, 15 aa, Mycobacterium tuberculosis
EEGVGLTLENADLSL

SEQ ID NO: 3118 - protein, 11 aa, Mycobacterium tuberculosis
VVNKIRGTFKS

SEQ ID NO: 3119 - protein, 16 aa, Mycobacterium tuberculosis
VVNKIRGTFKSVAVKA

SEQ ID NO: 3120 - protein, 13 aa, Homo sapiens
QDFTNRINKLKNS

SEQ ID NO: 3121 - protein, 8 aa, Streptococcus pyogenes
LTSRPAHG

SEQ ID NO: 3122 - protein, 12 aa, Mus musculus
LYFCAARSNYQL

SEQ ID NO: 3123 - protein, 15 aa, Rattus norvegicus
ALSTLVLNRLKVGLQ

SEQ ID NO: 3124 - protein, 15 aa, Homo sapiens
AYVLLSEKKISSIQS

SEQ ID NO: 3125 - protein, 15 aa, Homo sapiens
GEALSTLVLNRLKVG

SEQ ID NO: 3126 - protein, 15 aa, Mycobacterium
GEALSTLVVNKIRGT

SEQ ID NO: 3127 - protein, 15 aa, Homo sapiens
KCEFQDAYVLLSEKK

SEQ ID NO: 3128 - protein, 15 aa, Homo sapiens
VASLLTTAEVVVTEI

SEQ ID NO: 3129 - protein, 15 aa, Rattus norvegicus
KERYSTLYISNAQVE

SEQ ID NO: 3130 - protein, 15 aa, Homo sapiens
AVCRTSMCSIQSAPP

SEQ ID NO: 3131 - protein, 15 aa, Mus musculus
GEPGIAGFKGDQGPK

SEQ ID NO: 3132 - protein, 15 aa, Rattus norvegicus
GEPGIAGFKGEQGPK

SEQ ID NO: 3133 - protein, 8 aa, Rattus norvegicus
IAGFKGEQ

SEQ ID NO: 3134 - protein, 15 aa, Bos taurus
GEPGIAGFKGEQGPK

SEQ ID NO: 3135 - protein, 15 aa, Bos taurus
GEPGIAGFKGEQGPK

SEQ ID NO: 3136 - protein, 26 aa, Homo sapiens
AGAARDALQGFKITQNNAMKISFAKK

SEQ ID NO: 3137 - protein, 24 aa, Homo sapiens
EPAVYFKEQFLDGDGWTSRWIESK

SEQ ID NO: 3138 - protein, 23 aa, Homo sapiens
GRGRGRGRGRGRGRGRGRGGPRR

SEQ ID NO: 3139 - protein, 17 aa, Homo sapiens
KALSVETEKLLKYLEAV

SEQ ID NO: 3140 - protein, 24 aa, Homo sapiens
KMTLKNREPVQLETLSIRGNRIRY

SEQ ID NO: 3141 - protein, 15 aa, Homo sapiens
KPKAAKPKKAAAKKK

SEQ ID NO: 3142 - protein, 11 aa, Homo sapiens
MAVPETRPNHT

SEQ ID NO: 3143 - protein, 20 aa, Homo sapiens
MKLVRFLMKLSHETVTIELK

SEQ ID NO: 3144 - protein, 17 aa, Enterovirus A
MVTSTITEKLLKNLVKI

SEQ ID NO: 3145 - protein, 21 aa, Mus musculus
RIHMVYSKRSGKPRGYAFIEY

SEQ ID NO: 3146 - protein, 24 aa, Homo sapiens
SQFGQILDILVSRSLKMRGQAFVI

SEQ ID NO: 3147 - protein, 22 aa, Homo sapiens
TKYKQRNGWSHKDLLRLSHLKP

SEQ ID NO: 3148 - protein, 20 aa, Homo sapiens
TLHKAFKGSIFVVFDSIESA

SEQ ID NO: 3149 - protein, 37 aa, Homo sapiens
VEPKVKSKKREAVAGRGRGRGRGRGRGRGRGRGGPRR

SEQ ID NO: 3150 - protein, 15 aa, Homo sapiens
AARGRGRGMGRGNIF

SEQ ID NO: 3151 - protein, 22 aa, Homo sapiens
TKYKQRNGWSHKDLLRLSHLKP

SEQ ID NO: 3152 - protein, 22 aa, Homo sapiens
TKYKQRNGWSHKDLLRLSHLKP

SEQ ID NO: 3153 - protein, 25 aa, Homo sapiens
VAGRGRGRGRGRGRGRGRGRGGPRR

SEQ ID NO: 3154 - protein, 18 aa, Homo sapiens
RKGHFLLSSKSGFWTIWL

SEQ ID NO: 3155 - protein, 22 aa, Mus musculus
AGRGRGRGRGRGRGRGRGRGSL

SEQ ID NO: 3156 - protein, 16 aa, Homo sapiens
GKALCWVCAQSRKHRD

SEQ ID NO: 3157 - protein, 15 aa, Human Endogenous Retrovirus
GKTCPKEIPKGSKNT

SEQ ID NO: 3158 - protein, 16 aa, Homo sapiens
GLKKMLRTCAVHITLD

SEQ ID NO: 3159 - protein, 49 aa, Mus musculus
PLFPAGRGRGRGRGRGRGRGRGRGRGRGRGRGRGRGRGRGRGRGSLIYI

SEQ ID NO: 3160 - protein, 9 aa, Mycobacterium bovis
KPLLIIAED

SEQ ID NO: 3161 - protein, 10 aa, Human adenovirus
FWRFLWGSSQ

SEQ ID NO: 3162 - protein, 20 aa, Unknown
  epitope involved in rheumatoid arthritis
MSKTEWNASQLPRLGGKEDR

SEQ ID NO: 3163 - protein, 20 aa, Unknown
  epitope involved in rheumatoid arthritis
MSKTEWNASQSRFGWFENKE

SEQ ID NO: 3164 - protein, 11 aa, Influenza A virus
TLQRFAWGSSN

SEQ ID NO: 3165 - protein, 50 aa, Homo sapiens
GYGKINKKRIALTDNALIARSLGKYGIICMEDLIHEIYTVGKRFKEANNF

SEQ ID NO: 3166 - protein, 19 aa, Homo sapiens
RMARMARKAGNFYVPAEPK

SEQ ID NO: 3167 - protein, 15 aa, Homo sapiens
AAVGTSAAPVPSDNH

SEQ ID NO: 3168 - protein, 15 aa, Proteus mirabilis
FAESRIRRETIAAED

SEQ ID NO: 3169 - protein, 15 aa, Homo sapiens
GSLDSLRREIEQMRR

SEQ ID NO: 3170 - protein, 15 aa, Proteus mirabilis
LGSSESRRALQDSQR

SEQ ID NO: 3171 - protein, 5 aa, Homo sapiens
LRREI

SEQ ID NO: 3172 - protein, 16 aa, Homo sapiens
SQKDLLEQRRAAVDTY

SEQ ID NO: 3173 - protein, 21 aa, Bos taurus
ARTKQTARKSTGGKAPRKQLA

SEQ ID NO: 3174 - protein, 15 aa, Homo sapiens
EGNRPTNSIVFTKLT

SEQ ID NO: 3175 - protein, 15 aa, Homo sapiens
FNGEKINYTEGRAVL

SEQ ID NO: 3176 - protein, 15 aa, Homo sapiens
KIFVQGIIWDINSFD

SEQ ID NO: 3177 - protein, 21 aa, Bos taurus
LAGNAARDNKKTRIIPRHLQL

SEQ ID NO: 3178 - protein, 15 aa, Homo sapiens
LGKQLAKKIEPELDG

SEQ ID NO: 3179 - protein, 15 aa, Homo sapiens
MRMLVDLAKSRGVEA

SEQ ID NO: 3180 - protein, 16 aa, Bos taurus
PATGGVKKPHRYRPGT

SEQ ID NO: 3181 - protein, 13 aa, Homo sapiens
VEIRAEGNSRFTY

SEQ ID NO: 3182 - protein, 10 aa, Homo sapiens
ASAARLTMMW

SEQ ID NO: 3183 - protein, 16 aa, Homo sapiens
LFKPPKYHPDVPYVKR

SEQ ID NO: 3184 - protein, 15 aa, Homo sapiens
LRKFKNISYFPGKLR

SEQ ID NO: 3185 - protein, 17 aa, Homo sapiens
SKLIKIFQDHPLQKTYN

SEQ ID NO: 3186 - protein, 15 aa, Proteus mirabilis
ASRETKELRQEERQP

SEQ ID NO: 3187 - protein, 15 aa, Unknown
  epitope involved in rheumatoid arthritis
NGSSESRRALQDSQR

SEQ ID NO: 3188 - protein, 16 aa, Rattus norvegicus
YYVFFEEQEDEIIGFG

SEQ ID NO: 3189 - protein, 15 aa, Human herpesvirus
QKRAAQRAAGPSVAS

SEQ ID NO: 3190 - protein, 15 aa, Lactococcus lactis
QKRAAYDQYGEAGAN

SEQ ID NO: 3191 - protein, 15 aa, Brucella ovis
QKRAAYDRFGHAAFE

SEQ ID NO: 3192 - protein, 19 aa, Homo sapiens
LPNFSSLNLRETNLDSLPL

SEQ ID NO: 3193 - protein, 19 aa, Homo sapiens
LPNFSSLNLRETNLDSLPL

SEQ ID NO: 3194 - protein, 19 aa, Homo sapiens
SSRSYVTTSTRTYSLGSAL

SEQ ID NO: 3195 - protein, 7 aa, Unknown
  epitope involved in rheumatoid arthritis
ALPPPYM

SEQ ID NO: 3196 - protein, 7 aa, Unknown
  epitope involved in rheumatoid arthritis
ESMPALS

SEQ ID NO: 3197 - protein, 7 aa, Unknown
  epitope involved in rheumatoid arthritis
GTNTAQK

SEQ ID NO: 3198 - protein, 7 aa, Unknown
  epitope involved in rheumatoid arthritis
IPNSTHT

SEQ ID NO: 3199 - protein, 7 aa, Unknown
  epitope involved in rheumatoid arthritis
KWSFTPP

SEQ ID NO: 3200 - protein, 7 aa, Unknown
  epitope involved in rheumatoid arthritis
LHSDARD

SEQ ID NO: 3201 - protein, 7 aa, Unknown
  epitope involved in rheumatoid arthritis
LNTTLKV

SEQ ID NO: 3202 - protein, 7 aa, Unknown
  epitope involved in rheumatoid arthritis
LPYKLTQ

SEQ ID NO: 3203 - protein, 7 aa, Unknown
  epitope involved in rheumatoid arthritis
MVPELTE

SEQ ID NO: 3204 - protein, 7 aa, Unknown
  epitope involved in rheumatoid arthritis
PGPSTTS

SEQ ID NO: 3205 - protein, 16 aa, Homo sapiens
AAAGYDVEKNNSRIKL

SEQ ID NO: 3206 - protein, 16 aa, Homo sapiens
AAKPKTAKPKAAKPKK

SEQ ID NO: 3207 - protein, 16 aa, Homo sapiens
AGAAKRKASGPPVSEL

SEQ ID NO: 3208 - protein, 16 aa, Homo sapiens
AKKAGAAKAKKPAGAA

SEQ ID NO: 3209 - protein, 16 aa, Homo sapiens
APKSPAKAKAVKPKAA

SEQ ID NO: 3210 - protein, 16 aa, Homo sapiens
ATPKKSAKKTPKKAKK

SEQ ID NO: 3211 - protein, 16 aa, Homo sapiens
EKTPVKKKARKSAGAA

SEQ ID NO: 3212 - protein, 16 aa, Homo sapiens
IKLGLKSLVSKGTLVQ

SEQ ID NO: 3213 - protein, 15 aa, Unknown
  epitope involved in rheumatoid arthritis
IWYINCFACETHAML

SEQ ID NO: 3214 - protein, 15 aa, Unknown
  epitope involved in rheumatoid arthritis
IWYINCFVCETHAML

SEQ ID NO: 3215 - protein, 15 aa, Unknown
  epitope involved in rheumatoid arthritis
IWYISCFGCETHAML

SEQ ID NO: 3216 - protein, 15 aa, Unknown
  epitope involved in rheumatoid arthritis
IWYITCFGCETHAML

SEQ ID NO: 3217 - protein, 16 aa, Homo sapiens
KAKKPAAAAGAKKAKS

SEQ ID NO: 3218 - protein, 17 aa, Homo sapiens
KEIKKVATPKKASKPKK

SEQ ID NO: 3219 - protein, 16 aa, Homo sapiens
KLNKKAASGEAKPKAK

SEQ ID NO: 3220 - protein, 16 aa, Homo sapiens
KSPKKAKAAKPKKAPK

SEQ ID NO: 3221 - protein, 15 aa, Gallus gallus
KSRKASKAKKVKRSK

SEQ ID NO: 3222 - protein, 16 aa, Homo sapiens
LVQTKGTGASGSFKLN

SEQ ID NO: 3223 - protein, 16 aa, Homo sapiens
PAGAAKKPKKATGAAT

SEQ ID NO: 3224 - protein, 16 aa, Homo sapiens
RSGVSLAALKKALAAA

SEQ ID NO: 3225 - protein, 16 aa, Homo sapiens
SETAPAAPAAPAPAEK

SEQ ID NO: 3226 - protein, 16 aa, Gallus gallus
SKPRAKSGARKSPKKK

SEQ ID NO: 3227 - protein, 31 aa, Gallus gallus
TESLVLSPAPAKPKRVKASRRSASHPTYSEM

SEQ ID NO: 3228 - protein, 16 aa, Homo sapiens
VSELITKAVAASKERS

SEQ ID NO: 3229 - protein, 18 aa, Homo sapiens
CSAGWLADRSVRYPISKA

SEQ ID NO: 3230 - protein, 16 aa, Homo sapiens
IPCYFIDPMHPVTTAP

SEQ ID NO: 3231 - protein, 16 aa, Homo sapiens
KEKEVVLLVATEGRVR

SEQ ID NO: 3232 - protein, 18 aa, Homo sapiens
LADRSVRYPISKARPNCG

SEQ ID NO: 3233 - protein, 16 aa, Homo sapiens
LQKRSSRHPRRSRPST

SEQ ID NO: 3234 - protein, 18 aa, Homo sapiens
QAGMDMCSAGWLADRSVR

SEQ ID NO: 3235 - protein, 15 aa, Yersinia enterocolitica
QKQLGWQAGMDEART

SEQ ID NO: 3236 - protein, 16 aa, Homo sapiens
QPSPLRVLLGTSLTIP

SEQ ID NO: 3237 - protein, 16 aa, Homo sapiens
RVLLGTSLTIPCYFID

SEQ ID NO: 3238 - protein, 16 aa, Homo sapiens
RVNSAYQDKVSLPNYP

SEQ ID NO: 3239 - protein, 18 aa, Homo sapiens
TTGHVYLAWQAGMDMCSA

SEQ ID NO: 3240 - protein, 17 aa, Homo sapiens
VATEGRVRVNSAYQDKV

SEQ ID NO: 3241 - protein, 9 aa, Unknown
  epitope involved in rheumatoid arthritis
ASSLLASSP

SEQ ID NO: 3242 - protein, 9 aa, Unknown
  epitope involved in rheumatoid arthritis
IPFPTLFAP

SEQ ID NO: 3243 - protein, 9 aa, Unknown
  epitope involved in rheumatoid arthritis
PHESDATVR

SEQ ID NO: 3244 - protein, 9 aa, Unknown
  epitope involved in rheumatoid arthritis
PHNRQESPA

SEQ ID NO: 3245 - protein, 9 aa, Unknown
  epitope involved in rheumatoid arthritis
PPLKPVIDE

SEQ ID NO: 3246 - protein, 9 aa, Unknown
  epitope involved in rheumatoid arthritis
PSPSLSHPL

SEQ ID NO: 3247 - protein, 16 aa, Homo sapiens
KATLVCLISDFYPGAV

SEQ ID NO: 3248 - protein, 16 aa, Homo sapiens
SGLQAEDEADYYCSSY

SEQ ID NO: 3249 - protein, 16 aa, Homo sapiens
TGTSSDVGGYNYVSWY

SEQ ID NO: 3250 - protein, 8 aa, Homo sapiens
EVFISAPR

SEQ ID NO: 3251 - protein, 21 aa, Human T-lymphotropic virus
PPPPSSPTHDPPDSDPQIPPP

SEQ ID NO: 3252 - protein, 8 aa, Homo sapiens
PQIVPEPM

SEQ ID NO: 3253 - protein, 21 aa, Homo sapiens
PTRAPSGPRPPSRSQAQTPPR

SEQ ID NO: 3254 - protein, 12 aa, Homo sapiens
ATEGRVRVNSAY

SEQ ID NO: 3255 - protein, 6 aa, Homo sapiens
LTSRPA

SEQ ID NO: 3256 - protein, 20 aa, Homo sapiens
VVLLVATEGRVRVNSAYQDK

SEQ ID NO: 3257 - protein, 20 aa, Homo sapiens
VVLLVATEGRVRVNSAYQDK

SEQ ID NO: 3258 - protein, 18 aa, Unknown
  epitope involved in rheumatoid arthritis
GPPGARGLTGRPGDAGPP

SEQ ID NO: 3259 - protein, 18 aa, Unknown
  epitope involved in rheumatoid arthritis
GPPGARGLTGRPGDAGPP

SEQ ID NO: 3260 - protein, 37 aa, Unknown
  epitope involved in rheumatoid arthritis
GPPGPPGPPGPPGPPGARGLTGRPGDAGPPGPPGACA

SEQ ID NO: 3261 - protein, 206 aa, Homo sapiens
PSVFLFPPKPKDTLMISRTPEVTCVVVDVSQEDPQVQFNWYVDGVQVHNAKTKPREQQFNSTYRVVSVLTVLHQNWLDGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSL

SEQ ID NO: 3262 - protein, 9 aa, Burkholderia fungorum
RAGTDEGFG

SEQ ID NO: 3263 - protein, 20 aa, Homo sapiens
AFFPNMVNMLVLGKHLGIPK

SEQ ID NO: 3264 - protein, 17 aa, Homo sapiens
AKYNQLLRIEEELGSKA

SEQ ID NO: 3265 - protein, 18 aa, Homo sapiens
ANGWGVMVSHRSGETEDT

SEQ ID NO: 3266 - protein, 20 aa, Homo sapiens
APDRKGFRLLLASPRSCYKL

SEQ ID NO: 3267 - protein, 20 aa, Homo sapiens
CLEEKVCSLLEPLGLQCTFI

SEQ ID NO: 3268 - protein, 18 aa, Homo sapiens
EKGVPLYRHIADLAGNSE

SEQ ID NO: 3269 - protein, 20 aa, Homo sapiens
EPLGLQCTFINDFFTYHIRH

SEQ ID NO: 3270 - protein, 13 aa, Homo sapiens
ETTEESLRNYYEQ

SEQ ID NO: 3271 - protein, 14 aa, Homo sapiens
FEEYGKIDTIEIIT

SEQ ID NO: 3272 - protein, 20 aa, Homo sapiens
FPGLITLTISLLDTSNLELP

SEQ ID NO: 3273 - protein, 20 aa, Homo sapiens
FQEQQNEGHGEALLFEGIKK

SEQ ID NO: 3274 - protein, 19 aa, Homo sapiens
FRSGKYDLDFKSPDDPSRY

SEQ ID NO: 3275 - protein, 12 aa, Homo sapiens
GARGLTGRPGDA

SEQ ID NO: 3276 - protein, 12 aa, Homo sapiens
GARGLTGRPGDA

SEQ ID NO: 3277 - protein, 19 aa, Homo sapiens
IQVVGDDLTVTNPKRIAKA

SEQ ID NO: 3278 - protein, 20 aa, Homo sapiens
KAASGSTGDQKVQISYYGPK

SEQ ID NO: 3279 - protein, 13 aa, Homo sapiens
KFAGRNFRNPLAK

SEQ ID NO: 3280 - protein, 17 aa, Homo sapiens
KIHAREIFDSRGNPTVE

SEQ ID NO: 3281 - protein, 17 aa, Homo sapiens
KIHAREIFDSRGNPTVE

SEQ ID NO: 3282 - protein, 17 aa, Homo sapiens
KIHAREIFDSRGNPTVE

SEQ ID NO: 3283 - protein, 17 aa, Homo sapiens
KIHAREIFDSRGNPTVE

SEQ ID NO: 3284 - protein, 17 aa, Porphyromonas gingivalis
KIIGREILDSRGNPTVE

SEQ ID NO: 3285 - protein, 20 aa, Homo sapiens
KSVTTLAMKAKCKLTICPEE

SEQ ID NO: 3286 - protein, 20 aa, Homo sapiens
LLDTSNLELPEAVVFQDSVV

SEQ ID NO: 3287 - protein, 20 aa, Homo sapiens
LVNCDRDNLESSAMDCEDDE

SEQ ID NO: 3288 - protein, 20 aa, Homo sapiens
NDFFTYHIRHGEVHCGTNVR

SEQ ID NO: 3289 - protein, 18 aa, Homo sapiens
NFREAMRIGAEVYHNLKN

SEQ ID NO: 3290 - protein, 18 aa, Homo sapiens
NPKRIAKAVNEKSCNCLL

SEQ ID NO: 3291 - protein, 20 aa, Homo sapiens
PFGPVINGRCCLEEKVCSLL

SEQ ID NO: 3292 - protein, 20 aa, Homo sapiens
PGGKHNMDFYVEALAFPDTD

SEQ ID NO: 3293 - protein, 17 aa, Homo sapiens
RDYFEEYGKIDTIEIIT

SEQ ID NO: 3294 - protein, 20 aa, Homo sapiens
SINASPGVVVDIAHSPPAKK

SEQ ID NO: 3295 - protein, 17 aa, Homo sapiens
VDLFTSKGLFRAAVPSG

SEQ ID NO: 3296 - protein, 20 aa, Homo sapiens
VEALAFPDTDFPGLITLTIS

SEQ ID NO: 3297 - protein, 20 aa, Homo sapiens
VLDSEDLQDMSLMTLSTKTP

SEQ ID NO: 3298 - protein, 20 aa, Homo sapiens
VRVFQATRGKLSSKCSVVLG

SEQ ID NO: 3299 - protein, 20 aa, Homo sapiens
WGPCGQGAILLVNCDRDNLE

SEQ ID NO: 3300 - protein, 21 aa, Homo sapiens
YEALELRDNDKTRYMGKGVSK

SEQ ID NO: 3301 - protein, 25 aa, Homo sapiens
ACLDVGAVIATPEQLFAAYEDGFEQ

SEQ ID NO: 3302 - protein, 24 aa, Homo sapiens
DFDRAQRACLQNSAIIATPEQLQA

SEQ ID NO: 3303 - protein, 25 aa, Homo sapiens
FAAYEDGFEQCDAGWLADQTVRYPI

SEQ ID NO: 3304 - protein, 25 aa, Mus musculus
FAAYEDGFEQCDAGWLSDQTVRYPI

SEQ ID NO: 3305 - protein, 25 aa, Homo sapiens
FDQCDYGWLSDASVRHPVTVARAQC

SEQ ID NO: 3306 - protein, 25 aa, Homo sapiens
GVRTLYRFENQTGFPPPDSRFDAYC

SEQ ID NO: 3307 - protein, 24 aa, Homo sapiens
HQCDAGWLADQTVRYPIHTPREGC

SEQ ID NO: 3308 - protein, 23 aa, Mus musculus
IASPEQLFAAYEDGFEQCDAGWL

SEQ ID NO: 3309 - protein, 23 aa, Mus musculus
IATPEQLQAAYEDGFHQCDAGWL

SEQ ID NO: 3310 - protein, 24 aa, Homo sapiens
IATPEQLQAAYEDGFHQCDAGWLA

SEQ ID NO: 3311 - protein, 24 aa, Homo sapiens
LADRSVRYPISKARPNCGGNLLGV

SEQ ID NO: 3312 - protein, 25 aa, Homo sapiens
LHKVKVGKSPPVRGSLSGKVSLPCH

SEQ ID NO: 3313 - protein, 24 aa, Homo sapiens
PIHTPREGCYGDKDEFPGVRTYGI

SEQ ID NO: 3314 - protein, 25 aa, Homo sapiens
PPDSRFDAYCFKRRMSDLSVIGHPI

SEQ ID NO: 3315 - protein, 25 aa, Mus musculus
QAAYEDGFHQCDAGWLADQTVRYPI

SEQ ID NO: 3316 - protein, 25 aa, Homo sapiens
RLATVGELQAAWRNGFDQCDYGWLS

SEQ ID NO: 3317 - protein, 24 aa, Homo sapiens
RVSKEKEVVLLVATEGRVRVNSAY

SEQ ID NO: 3318 - protein, 13 aa, Homo sapiens
SDLSVIGHPIDSE

SEQ ID NO: 3319 - protein, 24 aa, Homo sapiens
YLAWQAGMDMCSAGWLADRSVRYP

SEQ ID NO: 3320 - protein, 20 aa, Mus musculus
HQCHQESTGRSRGRCGRSGS

SEQ ID NO: 3321 - protein, 21 aa, Mus musculus
HQCHQESTKGKSKGKCGKSGS

SEQ ID NO: 3322 - protein, 21 aa, Mus musculus
HQCHQESTKGKSKGKCGKSGS

SEQ ID NO: 3323 - protein, 19 aa, Mus musculus
SHQESTKGKSKGKSGKSGS

SEQ ID NO: 3324 - protein, 19 aa, Mus musculus
SHQESTKGKSKGKSGKSGS

SEQ ID NO: 3325 - protein, 7 aa, Homo sapiens
CSVMHEA

SEQ ID NO: 3326 - protein, 7 aa, Unknown
  epitope involved in rheumatoid arthritis
FRVVSVL

SEQ ID NO: 3327 - protein, 7 aa, Unknown
  epitope involved in rheumatoid arthritis
HNAKTKL

SEQ ID NO: 3328 - protein, 7 aa, Homo sapiens
MHEALHN

SEQ ID NO: 3329 - protein, 7 aa, Unknown
  epitope involved in rheumatoid arthritis
PREQQFN

SEQ ID NO: 3330 - protein, 7 aa, Unknown
  epitope involved in rheumatoid arthritis
QQFNSTF

SEQ ID NO: 3331 - protein, 7 aa, Homo sapiens
SVMHEAL

SEQ ID NO: 3332 - protein, 7 aa, Unknown
  epitope involved in rheumatoid arthritis
TFRVVSV

SEQ ID NO: 3333 - protein, 7 aa, Homo sapiens
VLTVLHQ

SEQ ID NO: 3334 - protein, 7 aa, Homo sapiens
VMHEALH

SEQ ID NO: 3335 - protein, 15 aa, Homo sapiens
DKKREEAPSLRPAPP

SEQ ID NO: 3336 - protein, 15 aa, Homo sapiens
DSPGSGNARPNNPDW

SEQ ID NO: 3337 - protein, 14 aa, Homo sapiens
EQSADSSRHSGSGH

SEQ ID NO: 3338 - protein, 15 aa, Homo sapiens
ERGSAGHWTSESSVS

SEQ ID NO: 3339 - protein, 14 aa, Homo sapiens
ESSRDGSRHPRSHD

SEQ ID NO: 3340 - protein, 15 aa, Homo sapiens
GDKELRTGKEKVTSG

SEQ ID NO: 3341 - protein, 15 aa, Homo sapiens
GPRVVERHQSACKDS

SEQ ID NO: 3342 - protein, 15 aa, Homo sapiens
GTFEEVSGNVSPGTR

SEQ ID NO: 3343 - protein, 15 aa, Homo sapiens
IEVLKRKVIEKVQHI

SEQ ID NO: 3344 - protein, 15 aa, Homo sapiens
LENLRSKIQKLESDV

SEQ ID NO: 3345 - protein, 15 aa, Homo sapiens
LLQQERPIRNSVDEL

SEQ ID NO: 3346 - protein, 15 aa, Homo sapiens
MELERPGGNEITRGG

SEQ ID NO: 3347 - protein, 15 aa, Homo sapiens
NRCHAANPNGRYYWG

SEQ ID NO: 3348 - protein, 15 aa, Homo sapiens
PEWKALTDMPQMRME

SEQ ID NO: 3349 - protein, 15 aa, Homo sapiens
PRKQCSKEDGGGWWY

SEQ ID NO: 3350 - protein, 15 aa, Homo sapiens
QKLESDVSAQMEYCR

SEQ ID NO: 3351 - protein, 15 aa, Homo sapiens
QNPGSPRPGSTGTWN

SEQ ID NO: 3352 - protein, 15 aa, Homo sapiens
RGHAKSRPVRGIHTS

SEQ ID NO: 3353 - protein, 15 aa, Homo sapiens
RPAPPPISGGGYRAR

SEQ ID NO: 3354 - protein, 15 aa, Homo sapiens
SCSRALAREVDLKDY

SEQ ID NO: 3355 - protein, 15 aa, Homo sapiens
SGCRMKGLIDEVNQD

SEQ ID NO: 3356 - protein, 15 aa, Homo sapiens
SGIGTLDGFRHRHPD

SEQ ID NO: 3357 - protein, 15 aa, Homo sapiens
SRGSESGIFTNTKES

SEQ ID NO: 3358 - protein, 15 aa, Homo sapiens
SSHHPGIAEFPSRGK

SEQ ID NO: 3359 - protein, 15 aa, Homo sapiens
SYNRGDSTFESKSYK

SEQ ID NO: 3360 - protein, 14 aa, Homo sapiens [sequence omitted]

SEQ ID NO: 3361 - protein, 18 aa, Homo sapiens
TIHAHPGSRRGGRHGYHH

SEQ ID NO: 3362 - protein, 15 aa, Homo sapiens
TTRRSCSKTVTKTVI

SEQ ID NO: 3363 - protein, 15 aa, Homo sapiens
VDIDIKIRSCRGSCS

SEQ ID NO: 3364 - protein, 15 aa, Homo sapiens
VIQNRQDGSVDFGRK

SEQ ID NO: 3365 - protein, 15 aa, Homo sapiens
WYNRCHAANPNGRYY

SEQ ID NO: 3366 - protein, 15 aa, Homo sapiens
WYSMRKMSMKIRPFF

SEQ ID NO: 3367 - protein, 15 aa, Homo sapiens
GGGYRARPAKAAATQ

SEQ ID NO: 3368 - protein, 15 aa, Homo sapiens
GKLYGIRDVRSTRDR

SEQ ID NO: 3369 - protein, 15 aa, Homo sapiens
YAEYHFRVGSEAEGY

SEQ ID NO: 3370 - protein, 20 aa, Porphyromonas gingivalis
TLVVNRLRGSLKICAVKAPG

SEQ ID NO: 3371 - protein, 17 aa, Homo sapiens
KIHAREIFDSRGNPTVE

SEQ ID NO: 3372 - protein, 19 aa, Homo sapiens
ANKYQISVNKYRGTAGNAL

SEQ ID NO: 3373 - protein, 30 aa, Homo sapiens
KYQISVNKYRGTAGNALMDGASQLMGENRT

SEQ ID NO: 3374 - protein, 30 aa, Homo sapiens; identical to SEQ ID NO: 3373

SEQ ID NO: 3375 - protein, 18 aa, Homo sapiens
NKYRGTAGNALMDGASQL

SEQ ID NO: 3376 - protein, 18 aa, Homo sapiens
NKYRGTAGNALMDGASQL

SEQ ID NO: 3377 - protein, 10 aa, Homo sapiens
LVVYPWTQRF

SEQ ID NO: 3378 - protein, 18 aa, Homo sapiens
QVTQPTVGMNFKTPRGPV

SEQ ID NO: 3379 - protein, 16 aa, Homo sapiens
RLPIIDVAPLDVGAPD

SEQ ID NO: 3380 - protein, 16 aa, Homo sapiens
TQGKIVDLVKELDRDT

SEQ ID NO: 3381 - protein, 9 aa, Human herpesvirus
GQSRGQSRG

SEQ ID NO: 3382 - protein, 21 aa, Human herpesvirus
GQSRGQSRGRGRGRGRGRGKG

SEQ ID NO: 3383 - protein, 15 aa, Human herpesvirus
GRGRGRGRGRGGGRG

SEQ ID NO: 3384 - protein, 8 aa, Homo sapiens
DLLPSRDR

SEQ ID NO: 3385 - protein, 8 aa, Homo sapiens
DLLPSRDR

SEQ ID NO: 3386 - protein, 9 aa, Homo sapiens
DRQHLPLIK

SEQ ID NO: 3387 - protein, 24 aa, Homo sapiens
EEAPSLRPAPPPISGGGYRARPAK

SEQ ID NO: 3388 - protein, 24 aa, Homo sapiens
EEAPSLRPAPPPISGGGYRARPAK

SEQ ID NO: 3389 - protein, 17 aa, Homo sapiens
ESSSHHPGIAEFPSRGK

SEQ ID NO: 3390 - protein, 15 aa, Homo sapiens
KDLLPSRDRQHLPLI

SEQ ID NO: 3391 - protein, 15 aa, Homo sapiens
KDLLPSRDRQHLPLI

SEQ ID NO: 3392 - protein, 17 aa, Homo sapiens
KESSSHHPGIAEFPSRG

SEQ ID NO: 3393 - protein, 18 aa, Homo sapiens
KQFTSSTSYNRGDSTFES

SEQ ID NO: 3394 - protein, 21 aa, Homo sapiens
KQFTSSTSYNRGDSTFESKSY

SEQ ID NO: 3395 - protein, 25 aa, Homo sapiens
KREEAPSLRPAPPPISGGGYRARPA

SEQ ID NO: 3396 - protein, 18 aa, Homo sapiens
QFTSSTSYNRGDSTFESK

SEQ ID NO: 3397 - protein, 13 aa, Homo sapiens
TSSTSYNRGDSTF

SEQ ID NO: 3398 - protein, 16 aa, Homo sapiens
GVYATRSSAVRLRSSV

SEQ ID NO: 3399 - protein, 16 aa, Homo sapiens
MSTRSVSSSSYRRMFG

SEQ ID NO: 3400 - protein, 20 aa, Bos taurus
MSGRGKQGGKARAKAKTRSS

SEQ ID NO: 3401 - protein, 3 aa, Unknown
  epitope involved in rheumatoid arthritis
AAA

SEQ ID NO: 3402 - protein, 38 aa, Mus musculus
KGSITSVQAIYVPADDLTDPAPATTFAHLDATTVLSRA

SEQ ID NO: 3403 - protein, 16 aa, Mus musculus
KLVIIESDLERAEERA

SEQ ID NO: 3404 - protein, 26 aa, Mus musculus
KSLQDIIAILGMDELSEEDKLTVSRA

SEQ ID NO: 3405 - protein, 18 aa, Mus musculus
RIMNVIGEPIDERGPIKT

SEQ ID NO: 3406 - protein, 16 aa, Mus musculus
RSITTIIDTFHQYSRK

SEQ ID NO: 3407 - protein, 32 aa, Mus musculus
RTTGIVLDSGDGVTHNVPIYEGYALPHAIMRL

SEQ ID NO: 3408 - protein, 16 aa, Mycobacterium tuberculosis
GLEPGVVAEKVRNLSV

SEQ ID NO: 3409 - protein, 18 aa, Homo sapiens
AFRGQYCYELDEKAVRPG

SEQ ID NO: 3410 - protein, 16 aa, Homo sapiens
AGYALAQMGRLKGPLL

SEQ ID NO: 3411 - protein, 17 aa, Homo sapiens
AISDYVFNTASLVYHEE

SEQ ID NO: 3412 - protein, 17 aa, Homo sapiens
AKNSLYLQMNSLRAEDT

SEQ ID NO: 3413 - protein, 16 aa, Homo sapiens
ALATISTLEAVRGRPF

SEQ ID NO: 3414 - protein, 13 aa, Homo sapiens
ALTNGIYPHKLVF

SEQ ID NO: 3415 - protein, 17 aa, Homo sapiens
AMKAAMALEKKLNQALL

SEQ ID NO: 3416 - protein, 16 aa, Homo sapiens
ANGVIHMLDGILLPPT

SEQ ID NO: 3417 - protein, 15 aa, Homo sapiens
ANLELINTWVAKNTN

SEQ ID NO: 3418 - protein, 14 aa, Homo sapiens
APELLFFAKRYKAA

SEQ ID NO: 3419 - protein, 15 aa, Homo sapiens
APRLLIYDASNRATG

SEQ ID NO: 3420 - protein, 15 aa, Homo sapiens
APSAILPLPGQSVER

SEQ ID NO: 3421 - protein, 16 aa, Homo sapiens
APVELILSDETLPAPE

SEQ ID NO: 3422 - protein, 15 aa, Homo sapiens
ARTQLSWLKKQLAAA

SEQ ID NO: 3423 - protein, 14 aa, Homo sapiens
ASHFEQMAAASMHR

SEQ ID NO: 3424 - protein, 16 aa, Homo sapiens
AYPRISVNNVLPVFDN

SEQ ID NO: 3425 - protein, 24 aa, Homo sapiens
DDDGTGQKQIWRIEGSNKVPVDPA

SEQ ID NO: 3426 - protein, 19 aa, Homo sapiens
DDLKTDFYKDLTSLGHNEN

SEQ ID NO: 3427 - protein, 16 aa, Homo sapiens
DEPQYLDLPSTATSVN

SEQ ID NO: 3428 - protein, 14 aa, Homo sapiens
DFNVGGYIQAVLDR

SEQ ID NO: 3429 - protein, 16 aa, Homo sapiens
DGKRIQYQLVDISQDN

SEQ ID NO: 3430 - protein, 17 aa, Homo sapiens
DGVREVFEMATRAALQA

SEQ ID NO: 3431 - protein, 15 aa, Homo sapiens
DHPTFNKITPNLAEF

SEQ ID NO: 3432 - protein, 15 aa, Homo sapiens
DHVKLVNEVTEFAKT

SEQ ID NO: 3433 - protein, 14 aa, Homo sapiens
DIRPEIHENYRING

SEQ ID NO: 3434 - protein, 15 aa, Homo sapiens
DKVLIRIMVSRSEVD

SEQ ID NO: 3435 - protein, 17 aa, Homo sapiens
EEVKLIKKMGDHLTNLH

SEQ ID NO: 3436 - protein, 16 aa, Homo sapiens
EGARNIVAAMKAHGVD

SEQ ID NO: 3437 - protein, 12 aa, Homo sapiens
EIINWLDKNQTA

SEQ ID NO: 3438 - protein, 15 aa, Homo sapiens
ENIPFTLPEVSTNKT

SEQ ID NO: 3439 - protein, 19 aa, Homo sapiens
EPHRHSIFTPETNPRAGLE

SEQ ID NO: 3440 - protein, 18 aa, Homo sapiens
EQLGEYKFQNALLVRYTK

SEQ ID NO: 3441 - protein, 14 aa, Homo sapiens
ERNLVSWESQTQPQ

SEQ ID NO: 3442 - protein, 15 aa, Homo sapiens
ERTITMHKDSTGHVG

SEQ ID NO: 3443 - protein, 11 aa, Homo sapiens
ETFLKDLPIMF

SEQ ID NO: 3444 - protein, 13 aa, Homo sapiens
ETYGEMADCCAKQ

SEQ ID NO: 3445 - protein, 12 aa, Homo sapiens
EVENAVLGKDFK

SEQ ID NO: 3446 - protein, 22 aa, Homo sapiens
FEKSKEQLTPLIKKAGTELVNF

SEQ ID NO: 3447 - protein, 14 aa, Homo sapiens
FEPFFMMIATPAPH

SEQ ID NO: 3448 - protein, 21 aa, Homo sapiens
FLEQQNKILLAELEQLKGQGK

SEQ ID NO: 3449 - protein, 9 aa, Homo sapiens
FLLFPDMEA

SEQ ID NO: 3450 - protein, 16 aa, Homo sapiens
FPGFLENQKDPLAVDK

SEQ ID NO: 3451 - protein, 17 aa, Homo sapiens
FQNALLVRYTKKVPQVS

SEQ ID NO: 3452 - protein, 17 aa, Homo sapiens
FRGQYCYELDEKAVRPG

SEQ ID NO: 3453 - protein, 17 aa, Homo sapiens
FRGQYCYELDEKAVRPG

SEQ ID NO: 3454 - protein, 12 aa, Homo sapiens
FSISPNAVSAEE

SEQ ID NO: 3455 - protein, 12 aa, Homo sapiens
FSSEESNLGANN

SEQ ID NO: 3456 - protein, 10 aa, Homo sapiens
FVELGTQPAT

SEQ ID NO: 3457 - protein, 14 aa, Homo sapiens
GAYYLKLENQSLKS

SEQ ID NO: 3458 - protein, 17 aa, Homo sapiens
GDIQQFLITGDPKAAYD

SEQ ID NO: 3459 - protein, 18 aa, Homo sapiens
GETSEMYLIQPDSSVKPY

SEQ ID NO: 3460 - protein, 15 aa, Homo sapiens
GGGYVKLFPNSLDQT

SEQ ID NO: 3461 - protein, 18 aa, Homo sapiens
GGHAIRILGWGVENGTPY

SEQ ID NO: 3462 - protein, 16 aa, Homo sapiens
GGQFLRAVAQRCPSPP

SEQ ID NO: 3463 - protein, 17 aa, Homo sapiens
GHLSFGFMQDLQQKVVY

SEQ ID NO: 3464 - protein, 16 aa, Homo sapiens
GIKSLVSKGTLVQTKG

SEQ ID NO: 3465 - protein, 16 aa, Homo sapiens
GLKSLVSKGTLVQTKG

SEQ ID NO: 3466 - protein, 14 aa, Homo sapiens
GLLWIALHGNQITS

SEQ ID NO: 3467 - protein, 15 aa, Homo sapiens
GNQFWAIRGNEVRAG

SEQ ID NO: 3468 - protein, 12 aa, Homo sapiens
GNRIAQWQSFQL

SEQ ID NO: 3469 - protein, 22 aa, Homo sapiens
GPDPSSPAFRIEDANLIPPVPD

SEQ ID NO: 3470 - protein, 19 aa, Homo sapiens
GPGIPGRFTKEAGTLAYYE

SEQ ID NO: 3471 - protein, 15 aa, Homo sapiens
GPVKVWGSIKGLTEG

SEQ ID NO: 3472 - protein, 15 aa, Homo sapiens
GQYCYELDEKAVRPG

SEQ ID NO: 3473 - protein, 17 aa, Homo sapiens
GSAGHWTSESSVSGSTG

SEQ ID NO: 3474 - protein, 16 aa, Homo sapiens
GSHSLKYFHTSVSRPG

SEQ ID NO: 3475 - protein, 18 aa, Homo sapiens
GTDVPKWISIMTERSVPH

SEQ ID NO: 3476 - protein, 18 aa, Homo sapiens
GTGENYRGNVAVTVSGHT

SEQ ID NO: 3477 - protein, 19 aa, Homo sapiens
GVDEVTIVNILTNRSNAQR

SEQ ID NO: 3478 - protein, 12 aa, Homo sapiens
GVIKVFNDMKVR

SEQ ID NO: 3479 - protein, 13 aa, Homo sapiens
GYVRDETVRAAPY

SEQ ID NO: 3480 - protein, 18 aa, Homo sapiens
HLPDNINVYATTAANPRE

SEQ ID NO: 3481 - protein, 16 aa, Homo sapiens
HNGNLIPTHTQPSYRF

SEQ ID NO: 3482 - protein, 17 aa, Homo sapiens
IGGVILFHETLYQKADD

SEQ ID NO: 3483 - protein, 14 aa, Homo sapiens
IKIISKIENHEGVR

SEQ ID NO: 3484 - protein, 14 aa, Homo sapiens
ILEWAAERGPITSA

SEQ ID NO: 3485 - protein, 17 aa, Homo sapiens
IQSTYDQDHTVPAYVPR

SEQ ID NO: 3486 - protein, 12 aa, Homo sapiens
ISTPEELGLDKV

SEQ ID NO: 3487 - protein, 16 aa, Homo sapiens
IVHRYMTITSERSVPA

SEQ ID NO: 3488 - protein, 11 aa, Homo sapiens
IYVFHTLGQYF

SEQ ID NO: 3489 - protein, 15 aa, Homo sapiens
KIGRFVIEEVPGELM

SEQ ID NO: 3490 - protein, 24 aa, Homo sapiens
KKVPQVSTPTLVEVSRNLGKVGSK

SEQ ID NO: 3491 - protein, 14 aa, Homo sapiens
KPQYMVLVPSLLHT

SEQ ID NO: 3492 - protein, 16 aa, Homo sapiens
KTGKLVSLSAQNLVDC

SEQ ID NO: 3493 - protein, 14 aa, Homo sapiens
LAEFAFSLYRQLAH

SEQ ID NO: 3494 - protein, 14 aa, Homo sapiens
LAVVKSIRSIPAYL

SEQ ID NO: 3495 - protein, 15 aa, Homo sapiens
LDDPKYSSDEDLPSK

SEQ ID NO: 3496 - protein, 15 aa, Homo sapiens
LDFLKAVDTNRASVG

SEQ ID NO: 3497 - protein, 12 aa, Homo sapiens
LGEFVSETESRG

SEQ ID NO: 3498 - protein, 15 aa, Homo sapiens
LGQHLLPWMDRLSLE

SEQ ID NO: 3499 - protein, 15 aa, Homo sapiens
LINEYWVLTAAHVVE

SEQ ID NO: 3500 - protein, 17 aa, Homo sapiens
LKQEYFVVAATLQDIIR

SEQ ID NO: 3501 - protein, 17 aa, Homo sapiens
LKTGKLVSLSAQNLVDC

SEQ ID NO: 3502 - protein, 16 aa, Homo sapiens
LMHPDALEEPDDQNRI

SEQ ID NO: 3503 - protein, 16 aa, Homo sapiens
LNQELRADGTVNQIEG

SEQ ID NO: 3504 - protein, 18 aa, Homo sapiens
LPQPDLRYLFLNGNKLAR

SEQ ID NO: 3505 - protein, 17 aa, Homo sapiens
LRVLRAQPVQVAEGSEP

SEQ ID NO: 3506 - protein, 16 aa, Homo sapiens
LSKELQAAQARLGADM

SEQ ID NO: 3507 - protein, 14 aa, Homo sapiens
LVAYYTLIGASGQR

SEQ ID NO: 3508 - protein, 13 aa, Homo sapiens
MQQKLVDQNIFSF

SEQ ID NO: 3509 - protein, 13 aa, Homo sapiens
MVKVLDAVRGSPA

SEQ ID NO: 3510 - protein, 16 aa, Homo sapiens
NDVKNVIIWGNHSSTQ

SEQ ID NO: 3511 - protein, 16 aa, Homo sapiens
NEEEIRANVAVVSGAP

SEQ ID NO: 3512 - protein, 23 aa, Homo sapiens
NLDFLKAVDTNRASVGQDSPEPR

SEQ ID NO: 3513 - protein, 15 aa, Homo sapiens
NPAEFVVNTSNAGAG

SEQ ID NO: 3514 - protein, 15 aa, Homo sapiens
NPGTFRILVGNKGCS

SEQ ID NO: 3515 - protein, 18 aa, Homo sapiens
NPGTFRILVGNKGCSHPS

SEQ ID NO: 3516 - protein, 17 aa, Homo sapiens
NPLEIVSIPDNHGHIDP

SEQ ID NO: 3517 - protein, 15 aa, Homo sapiens
NSNQIKILGNQGSFL

SEQ ID NO: 3518 - protein, 16 aa, Homo sapiens
NVPTIDIHMNQIGFER

SEQ ID NO: 3519 - protein, 16 aa, Homo sapiens
QGGTYSKASTPNGYDN

SEQ ID NO: 3520 - protein, 16 aa, Homo sapiens
QPLGMISLMKRPPGFS

SEQ ID NO: 3521 - protein, 15 aa, Homo sapiens
QSGEYWIDPNQGSVE

SEQ ID NO: 3522 - protein, 25 aa, Homo sapiens
QSLPHENKPLTLSNYQTNKAKHDEL

SEQ ID NO: 3523 - protein, 19 aa, Homo sapiens
QTVAVGVIKAVDKKAAGAG

SEQ ID NO: 3524 - protein, 13 aa, Homo sapiens
RIEGSNKVPVDPA

SEQ ID NO: 3525 - protein, 16 aa, Homo sapiens
RLPGLAKQPSFRQYSG

SEQ ID NO: 3526 - protein, 16 aa, Homo sapiens
RPLLDKWPTTLSRHLG

SEQ ID NO: 3527 - protein, 16 aa, Homo sapiens
RPRAPIIAVTRNPQTA

SEQ ID NO: 3528 - protein, 15 aa, Homo sapiens
SARLTWDPTSRQING

SEQ ID NO: 3529 - protein, 16 aa, Homo sapiens
SDTSYVSLKAPLTKPL

SEQ ID NO: 3530 - protein, 15 aa, Homo sapiens
SDVDLIPMNDHNAYR

SEQ ID NO: 3531 - protein, 13 aa, Homo sapiens
SFYLSRDPDAQPG

SEQ ID NO: 3532 - protein, 16 aa, Homo sapiens
SGDVFTALIGEIASPN

SEQ ID NO: 3533 - protein, 18 aa, Homo sapiens
SGKPQYMVLVPSLLHTET

SEQ ID NO: 3534 - protein, 18 aa, Homo sapiens
SGLEVIDAMRSQLGKATA

SEQ ID NO: 3535 - protein, 17 aa, Homo sapiens
SKNTLYLQMNSLRAEDT

SEQ ID NO: 3536 - protein, 19 aa, Homo sapiens
SLRPKDYEVDATLKSLNNQ

SEQ ID NO: 3537 - protein, 17 aa, Homo sapiens
SPDRIFFHLNAVALGDG

SEQ ID NO: 3538 - protein, 18 aa, Homo sapiens
SPERPFLAILGGAKVADK

SEQ ID NO: 3539 - protein, 17 aa, Homo sapiens
SPLSVALALSHLALGAQ

SEQ ID NO: 3540 - protein, 14 aa, Homo sapiens
SPMYSIITPNILRL

SEQ ID NO: 3541 - protein, 19 aa, Homo sapiens
SPPISYIWYKQQTNNQEPI

SEQ ID NO: 3542 - protein, 19 aa, Homo sapiens
SPVTGYRVTTTPKNGPGPT

SEQ ID NO: 3543 - protein, 17 aa, Homo sapiens
SRLPIIDVAPLDVGAPD

SEQ ID NO: 3544 - protein, 16 aa, Homo sapiens
SYAGKYVPAIAHLIHS

SEQ ID NO: 3545 - protein, 15 aa, Homo sapiens
TAADYKILGGSVLHL

SEQ ID NO: 3546 - protein, 21 aa, Homo sapiens
TEEEFVEGIYKVEIDTKSYWK

SEQ ID NO: 3547 - protein, 18 aa, Homo sapiens
TGAQELLRVLRAQPVQVA

SEQ ID NO: 3548 - protein, 18 aa, Homo sapiens
TGDAYVILKTVQLRNGNL

SEQ ID NO: 3549 - protein, 14 aa, Homo sapiens
TGKLVSLSAQNLVD

SEQ ID NO: 3550 - protein, 15 aa, Homo sapiens
TGKLVSLSAQNLVDC

SEQ ID NO: 3551 - protein, 15 aa, Homo sapiens
TGNYRIESVLSSSGK

SEQ ID NO: 3552 - protein, 15 aa, Homo sapiens
THMLDVMQDHFSRAS

SEQ ID NO: 3553 - protein, 16 aa, Homo sapiens
TIYVIALKNNQKSEPL

SEQ ID NO: 3554 - protein, 16 aa, Homo sapiens
TLNQIDEVKVWPQQPS

SEQ ID NO: 3555 - protein, 16 aa, Homo sapiens
TLQSFRQDVDNASLAR

SEQ ID NO: 3556 - protein, 17 aa, Homo sapiens
TSATNIVKWITKQQNAQ

SEQ ID NO: 3557 - protein, 15 aa, Homo sapiens
TTAFQYIIDNKGIDS

SEQ ID NO: 3558 - protein, 19 aa, Homo sapiens
VAIQLNDTHPSLAIPELMR

SEQ ID NO: 3559 - protein, 21 aa, Homo sapiens
VDDTQFVRFDSDAASPRTEPR

SEQ ID NO: 3560 - protein, 18 aa, Homo sapiens
VDDTSIVVRWSRPQAPIT

SEQ ID NO: 3561 - protein, 17 aa, Homo sapiens
VDMDFEVENAVLGKDFK

SEQ ID NO: 3562 - protein, 15 aa, Homo sapiens
VFNILRMMPKGAALH

SEQ ID NO: 3563 - protein, 19 aa, Homo sapiens
VGPVDEVRELQKAIGAVPL

SEQ ID NO: 3564 - protein, 15 aa, Homo sapiens
VHPKVTVYPSKTQPL

SEQ ID NO: 3565 - protein, 15 aa, Homo sapiens
VPPEWKALTDMPQMR

SEQ ID NO: 3566 - protein, 16 aa, Homo sapiens
VPVPVFCDMTTEGGKW

SEQ ID NO: 3567 - protein, 17 aa, Homo sapiens
VPVPVFCDMTTEGGKWT

SEQ ID NO: 3568 - protein, 14 aa, Homo sapiens
VPYVIVPLKTGLQE

SEQ ID NO: 3569 - protein, 15 aa, Homo sapiens
VSGTLVLLQGARGFA

SEQ ID NO: 3570 - protein, 15 aa, Homo sapiens
VSQYFQTVTDYGKDL

SEQ ID NO: 3571 - protein, 15 aa, Homo sapiens
VSTAFVYTKNPNGYS

SEQ ID NO: 3572 - protein, 19 aa, Homo sapiens
VVLPSYEEALSLPSKTPEG

SEQ ID NO: 3573 - protein, 15 aa, Homo sapiens
VVYYRVQNATLAVAN

SEQ ID NO: 3574 - protein, 18 aa, Homo sapiens
YDGKDYIALKEDLRSWTA

SEQ ID NO: 3575 - protein, 19 aa, Homo sapiens
YDGSHRYVILKSEPVHPFG

SEQ ID NO: 3576 - protein, 26 aa, Homo sapiens
YDLRHTFMGVVSLGSPSGEVSHPRKT

SEQ ID NO: 3577 - protein, 12 aa, Homo sapiens
YLQMNSLRVEDT

SEQ ID NO: 3578 - protein, 12 aa, Homo sapiens
YLQMNSVRAEDT

SEQ ID NO: 3579 - protein, 11 aa, Homo sapiens
YVNGLTLGGQK

SEQ ID NO: 3580 - protein, 15 aa, Homo sapiens
CDMNTENGGWTVIQN

SEQ ID NO: 3581 - protein, 15 aa, Homo sapiens
DVSAQMEYCRTPCTV

SEQ ID NO: 3582 - protein, 15 aa, Homo sapiens
DWPFCSDEDWNYKCP

SEQ ID NO: 3583 - protein, 15 aa, Homo sapiens
EAVQSTSSSSQFYMY

SEQ ID NO: 3584 - protein, 15 aa, Homo sapiens
FTNRINKLKNSLFEY

SEQ ID NO: 3585 - protein, 15 aa, Homo sapiens
GDKELRTGKEKVTSG

SEQ ID NO: 3586 - protein, 12 aa, Mycobacterium tuberculosis
GLEPGVVAEKVR

SEQ ID NO: 3587 - protein, 15 aa, Homo sapiens
GSSERGSAGHWTSES

SEQ ID NO: 3588 - protein, 15 aa, Homo sapiens
IRVLRSILENLRSKI

SEQ ID NO: 3589 - protein, 15 aa, Homo sapiens
ITSDPRKQCSKEDGG

SEQ ID NO: 3590 - protein, 15 aa, Homo sapiens
LENLRSKIQKLESDV

SEQ ID NO: 3591 - protein, 11 aa, Mycobacterium tuberculosis
LEPGVVAEKVR

SEQ ID NO: 3592 - protein, 15 aa, Homo sapiens
LLQQERPIRNSVDEL

SEQ ID NO: 3593 - protein, 15 aa, Homo sapiens
LMGENRTMTIHNGMF

SEQ ID NO: 3594 - protein, 15 aa, Homo sapiens
NSNIPTNLRVLRSIL

SEQ ID NO: 3595 - protein, 15 aa, Homo sapiens
PRKQCSKEDGGGWWY

SEQ ID NO: 3596 - protein, 15 aa, Homo sapiens
QKLESDVSAQMEYCR

SEQ ID NO: 3597 - protein, 15 aa, Homo sapiens
QKQLEQVIAKDLLPS

SEQ ID NO: 3598 - protein, 15 aa, Homo sapiens
QMEYCRTPCTVSCNI

SEQ ID NO: 3599 - protein, 15 aa, Homo sapiens
QNPGSPRPGSTGTWN

SEQ ID NO: 3600 - protein, 15 aa, Homo sapiens
SETESRGSESGIFTN

SEQ ID NO: 3601 - protein, 15 aa, Homo sapiens
SGCRMKGLIDEVNQD

SEQ ID NO: 3602 - protein, 15 aa, Homo sapiens
SGPGSTGNRNPGSSG

SEQ ID NO: 3603 - protein, 15 aa, Homo sapiens
TPCTVSCNIPVVSGK

SEQ ID NO: 3604 - protein, 15 aa, Homo sapiens
TTRRSCSKTVTKTVI

SEQ ID NO: 3605 - protein, 15 aa, Homo sapiens
TVQNEANKYQISVNK

SEQ ID NO: 3606 - protein, 15 aa, Homo sapiens
VDIDIKIRSCRGSCS

SEQ ID NO: 3607 - protein, 15 aa, Homo sapiens
VDIDIKIRSCRGSCS

SEQ ID NO: 3608 - protein, 15 aa, Homo sapiens
VSPGTRREYHTEKLV

SEQ ID NO: 3609 - protein, 15 aa, Homo sapiens
VVWMNWKGSWYSMRK

SEQ ID NO: 3610 - protein, 15 aa, Homo sapiens
WYNRCHAANPNGRYY

SEQ ID NO: 3611 - protein, 15 aa, Homo sapiens
WYSMRKMSMKIRPFF

SEQ ID NO: 3612 - protein, 15 aa, Homo sapiens
YCGLPGEYWLGNDKI

SEQ ID NO: 3613 - protein, 17 aa, Homo sapiens
NEEGFFSARGHRPLDKK

SEQ ID NO: 3614 - protein, 15 aa, Homo sapiens
GPRVVERHQSACKDS

SEQ ID NO: 3615 - protein, 17 aa, Homo sapiens
KIHAREIFDSRGNPTVE

SEQ ID NO: 3616 - protein, 15 aa, Homo sapiens
VYATRSSAVRLRSSV

SEQ ID NO: 3617 - protein, 20 aa, Homo sapiens
GVYATRSSAVRLRSSVPGVR

SEQ ID NO: 3618 - protein, 20 aa, Homo sapiens
GVYATRSSAVRLRSSVPGVR

SEQ ID NO: 3619 - protein, 5 aa, Homo sapiens
GYRAR

SEQ ID NO: 3620 - protein, 4 aa, Homo sapiens
RVVE

SEQ ID NO: 3621 - protein, 15 aa, Homo sapiens
SGIGTLDGFRHRHPD

SEQ ID NO: 3622 - protein, 5 aa, Homo sapiens
VERHQ

SEQ ID NO: 3623 - protein, 20 aa, Homo sapiens
AAAIAYGLDKREGEKNILVF

SEQ ID NO: 3624 - protein, 20 aa, Homo sapiens
AGTIAGLNVMRIINEPTAAA

SEQ ID NO: 3625 - protein, 20 aa, Homo sapiens
AKFEELNMDLFRSTMKPVQK

SEQ ID NO: 3626 - protein, 20 aa, Homo sapiens
AKRALSSQHQARIEIESFYE

SEQ ID NO: 3627 - protein, 20 aa, Homo sapiens
AKRALSSQHQARIEIESFYE

SEQ ID NO: 3628 - protein, 20 aa, Homo sapiens
ATNGDTHLGGEDFDQRVMEH

SEQ ID NO: 3629 - protein, 20 aa, Homo sapiens
EDKKEDVGTVVGIDLGTTYS

SEQ ID NO: 3630 - protein, 21 aa, Homo sapiens
EDKKLKERIDTRNELESYAYS

SEQ ID NO: 3631 - protein, 20 aa, Homo sapiens
ESHQDADIEDFKAKKKELEE

SEQ ID NO: 3632 - protein, 20 aa, Homo sapiens
FAEEDKKLKERIDTRNELES

SEQ ID NO: 3633 - protein, 20 aa, Homo sapiens
GSAGPPPTGEEDTAELHHHH

SEQ ID NO: 3634 - protein, 20 aa, Homo sapiens
IDEIVLVGGSTRIPKIQQLV

SEQ ID NO: 3635 - protein, 20 aa, Homo sapiens
KDNRAVQKLRREVEKAKRAL

SEQ ID NO: 3636 - protein, 20 aa, Homo sapiens
KETMEKAVEEKIEWLESHQD

SEQ ID NO: 3637 - protein, 16 aa, Homo sapiens
KIHAREIFDSRGNPTV

SEQ ID NO: 3638 - protein, 20 aa, Homo sapiens
KLRREVEKAKRALSSQHQAR

SEQ ID NO: 3639 - protein, 20 aa, Homo sapiens
KTGKDVRKDNRAVQKLRREV

SEQ ID NO: 3640 - protein, 20 aa, Homo sapiens
KTGKDVRKDNRAVQKLRREV

SEQ ID NO: 3641 - protein, 20 aa, Homo sapiens
LYKKKTGKDVRKDNRAVQKL

SEQ ID NO: 3642 - protein, 20 aa, Homo sapiens
NKITITNDQNRLTPEEIERM

SEQ ID NO: 3643 - protein, 20 aa, Homo sapiens
NPENTVFDAKRLIGRTWNDP

SEQ ID NO: 3644 - protein, 20 aa, Homo sapiens
QNRLTPEEIERMVNDAEKFA

SEQ ID NO: 3645 - protein, 20 aa, Homo sapiens
RKDNRAVQKLRREVEKAKRA

SEQ ID NO: 3646 - protein, 20 aa, Homo sapiens
RKDNRAVQKLRREVEKAKRA

SEQ ID NO: 3647 - protein, 20 aa, Homo sapiens
SYVAFTPEGERLIGDAAKNQ

SEQ ID NO: 3648 - protein, 20 aa, Homo sapiens
TFEIDVNGILRVTAEDKGTG

SEQ ID NO: 3649 - protein, 20 aa, Homo sapiens
TFEIDVNGILRVTAEDKGTG

SEQ ID NO: 3650 - protein, 20 aa, Homo sapiens
TVGGVMTKLIPRNTVVPTKK

SEQ ID NO: 3651 - protein, 20 aa, Homo sapiens
TVPAYFNDAQRQATKDAGTI

SEQ ID NO: 3652 - protein, 20 aa, Homo sapiens
TVTIKVYEGERPLTKDNHLL

SEQ ID NO: 3653 - protein, 20 aa, Homo sapiens
VEIIANDQGNRITPSYVAFT

SEQ ID NO: 3654 - protein, 20 aa, Homo sapiens
VKEFFNGKEPSRGINPDEAV

SEQ ID NO: 3655 - protein, 20 aa, Homo sapiens
YEGEDFSETLTRAKFEELNM

SEQ ID NO: 3656 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3657 - protein, 15 aa, Rattus norvegicus
GIAGFKGEQGPKGET

SEQ ID NO: 3658 - protein, 15 aa, Rattus norvegicus
GIAGFKGEQGPKGET

SEQ ID NO: 3659 - protein, 15 aa, Rattus norvegicus
GIAGFKGEQGPKGET

SEQ ID NO: 3660 - protein, 15 aa, Unknown
  epitope involved in rheumatoid arthritis
GIAGNKGDQGPKGEB

SEQ ID NO: 3661 - protein, 20 aa, Mycobacterium tuberculosis
TLVVNKIRGTFKSVAVKAPG

SEQ ID NO: 3662 - protein, 20 aa, Chlamydia pneumoniae
TLVVNKLQGLLQVTVVTIPQ

SEQ ID NO: 3663 - protein, 14 aa, Homo sapiens
LTVGLTRRGQPRQY

SEQ ID NO: 3664 - protein, 14 aa, Homo sapiens
LTVGLTRRGQPRQY

SEQ ID NO: 3665 - protein, 13 aa, Homo sapiens
YNQYSQRYHQRTN

SEQ ID NO: 3666 - protein, 13 aa, Homo sapiens
APAPTARNKLTSE

SEQ ID NO: 3667 - protein, 21 aa, Homo sapiens
DAPRAVFPSIVGRPRHQGVMV

SEQ ID NO: 3668 - protein, 12 aa, Homo sapiens
EAQSKRGILTLK

SEQ ID NO: 3669 - protein, 11 aa, Homo sapiens
ERLGPLVEQGR

SEQ ID NO: 3670 - protein, 10 aa, Homo sapiens
GPSIVHRKCF

SEQ ID NO: 3671 - protein, 16 aa, Homo sapiens
IWHHTFYNELRVAPEE

SEQ ID NO: 3672 - protein, 15 aa, Homo sapiens
KLTSEARGRIPVAQK

SEQ ID NO: 3673 - protein, 20 aa, Homo sapiens
LAVYQAGAREGAERGLSAIR

SEQ ID NO: 3674 - protein, 14 aa, Homo sapiens
LDLAGRDLTDYLMK

SEQ ID NO: 3675 - protein, 27 aa, Homo sapiens
MKILTERGYSFTTTAEREIVRDIKEKL

SEQ ID NO: 3676 - protein, 11 aa, Homo sapiens
PGIADRMQKEI

SEQ ID NO: 3677 - protein, 13 aa, Homo sapiens
RQVDARRNVPQND

SEQ ID NO: 3678 - protein, 13 aa, Homo sapiens
QYMRADQAAGGLR

SEQ ID NO: 3679 - protein, 13 aa, Homo sapiens
SAVRARSSVPGVR

SEQ ID NO: 3680 - protein, 19 aa, Homo sapiens
ALMRGKSTEEARKELQAAG

SEQ ID NO: 3681 - protein, 19 aa, Homo sapiens
AMLPYDQYLHRFAAYFQQG

SEQ ID NO: 3682 - protein, 19 aa, Homo sapiens
ASTNGLINFIKQQREARVQ

SEQ ID NO: 3683 - protein, 19 aa, Homo sapiens
DLAKSRGVEAARERMFNGE

SEQ ID NO: 3684 - protein, 19 aa, Homo sapiens
EDLERLLPHKVFEGNRPTN

SEQ ID NO: 3685 - protein, 19 aa, Homo sapiens
FEFWDWVGGRYSLWSAIGL

SEQ ID NO: 3686 - protein, 19 aa, Homo sapiens
KLQQWYREHRSELNLRRLF

SEQ ID NO: 3687 - protein, 19 aa, Homo sapiens
NYTEGRAVLHVALRNRSNT

SEQ ID NO: 3688 - protein, 19 aa, Homo sapiens
SFCQRVRSGDWKGYTGKTI

SEQ ID NO: 3689 - protein, 16 aa, Homo sapiens
VYATRSSAVRLRSSVP

SEQ ID NO: 3690 - protein, 17 aa, Homo sapiens
NEEGFFSARGHRPLDKK

SEQ ID NO: 3691 - protein, 19 aa, Homo sapiens
SHQESTRGRSRGRSGRSGS

SEQ ID NO: 3692 - protein, 5 aa, Homo sapiens
TRGRS

SEQ ID NO: 3693 - protein, 36 aa, Unknown
  epitope involved in rheumatoid arthritis
HSTKRGHAKSRPVRGHQSHQESTRGRSRGRSGRSGS

SEQ ID NO: 3694 - protein, 15 aa, Trypanosoma cruzi
AEEEEDDDMGFGLFD

SEQ ID NO: 3695 - protein, 32 aa, Trypanosoma cruzi
ASAPTAAAAASGGAAAPAAAAEEEEDDDMGFG

SEQ ID NO: 3696 - protein, 35 aa, Trypanosoma cruzi
ASAPTAAAAASGGAAAPAAAAEEEEDDDMGFGLFD

SEQ ID NO: 3697 - protein, 18 aa, Homo sapiens
CAPESIEFPVSEARVLED

SEQ ID NO: 3698 - protein, 10 aa, Homo sapiens
DDDMGFGLFD

SEQ ID NO: 3699 - protein, 16 aa, Mycobacterium tuberculosis
DLSLLGKARKVVVTKD

SEQ ID NO: 3700 - protein, 13 aa, Trypanosoma cruzi
EEEDDDMGFGLFD

SEQ ID NO: 3701 - protein, 13 aa, Homo sapiens
EESDDDMGFGLFD

SEQ ID NO: 3702 - protein, 17 aa, Homo sapiens
ENPVVHFFKNIVTPRTP

SEQ ID NO: 3703 - protein, 5 aa, Homo sapiens
ERKRR

SEQ ID NO: 3704 - protein, 12 aa, Mus musculus
FYNQKFKGKATL

SEQ ID NO: 3705 - protein, 15 aa, Human herpesvirus
GDDGDDGDEGGDGDE

SEQ ID NO: 3706 - protein, 24 aa, Human herpesvirus
GGDNHGRGRGRGRGRGGGRPGAPG

SEQ ID NO: 3707 - protein, 9 aa, Human herpesvirus
GLCTLVAML

SEQ ID NO: 3708 - protein, 18 aa, Homo sapiens
GPSQQVMTPQGRGTVAAA

SEQ ID NO: 3709 - protein, 10 aa, Homo sapiens
HLKAVKMTLK

SEQ ID NO: 3710 - protein, 9 aa, Homo sapiens
ILQDGRIFI

SEQ ID NO: 3711 - protein, 22 aa, Artemia franciscana
KKEEKKEESEEEDEDMGFGLFD

SEQ ID NO: 3712 - protein, 24 aa, Mus musculus
KRHRKVLRDNIQGITKPAIRRLAR

SEQ ID NO: 3713 - protein, 17 aa, Homo sapiens
KRVLGLVLLRGENLVSM

SEQ ID NO: 3714 - protein, 7 aa, Trypanosoma cruzi
MGFGLFD

SEQ ID NO: 3715 - protein, 20 aa, Homo sapiens
PTRAETREERMERKRREKIE

SEQ ID NO: 3716 - protein, 16 aa, Homo sapiens
QPHDLGKVGEVIVTKD

SEQ ID NO: 3717 - protein, 9 aa, Homo sapiens
SIRGNNIRY

SEQ ID NO: 3718 - protein, 24 aa, Mus musculus
TYTEHAKRKTVTAMDVVYALKRQG

SEQ ID NO: 3719 - protein, 13 aa, Human herpesvirus
RGQGDGGRRKKGG

SEQ ID NO: 3720 - protein, 21 aa, Mus musculus
AAMAARPHSIDGRVVEPKRAV

SEQ ID NO: 3721 - protein, 22 aa, Mus musculus
AEVRKALSRQEMQEVQSSRSGR

SEQ ID NO: 3722 - protein, 16 aa, Homo sapiens
CKPISGHNSLFWYRQT

SEQ ID NO: 3723 - protein, 16 aa, Homo sapiens
DAGVIQSPRHEVTEMG

SEQ ID NO: 3724 - protein, 21 aa, Mus musculus
DKIVLQKYHTINGHNAEVRKA

SEQ ID NO: 3725 - protein, 10 aa, Homo sapiens
DPISGHVSLF

SEQ ID NO: 3726 - protein, 16 aa, Homo sapiens
KIQPSEPRDSAVYFCA

SEQ ID NO: 3727 - protein, 10 aa, Homo sapiens
KPISGHNSLF

SEQ ID NO: 3728 - protein, 21 aa, Mus musculus
LTDCVVMRDPASKRSRGFGFV

SEQ ID NO: 3729 - protein, 21 aa, Mus musculus
MEREKEQFRKLFIGGLSFETT

SEQ ID NO: 3730 - protein, 16 aa, Homo sapiens
QPLKEQPALNDSRYCL

SEQ ID NO: 3731 - protein, 21 aa, Mus musculus
RGFGFVTFSSMAEVDAAMAAR

SEQ ID NO: 3732 - protein, 11 aa, Homo sapiens
RSLDFQATTMF

SEQ ID NO: 3733 - protein, 27 aa, Mus musculus
SGKPGAHVTVKKLFVGGIKEDTEEHHL

SEQ ID NO: 3734 - protein, 10 aa, Homo sapiens
SPRSGDLSVY

SEQ ID NO: 3735 - protein, 25 aa, Homo sapiens
AQGTLSKIFKLGGRDSRSGSPMARR

SEQ ID NO: 3736 - protein, 19 aa, Mus musculus
LSRFSWGAEGQKPGFGYGG

SEQ ID NO: 3737 - protein, 21 aa, Mus musculus
MEVGWYRSPFSRVVHLYRNGK

SEQ ID NO: 3738 - protein, 18 aa, Homo sapiens
KEQFLDGDGWTSRWIESK

SEQ ID NO: 3739 - protein, 21 aa, Homo sapiens
RIHMVYSKRSGKPRGYAFIEY

SEQ ID NO: 3740 - protein, 10 aa, Homo sapiens
YTCPLCRAPV

SEQ ID NO: 3741 - protein, 10 aa, Homo sapiens
DWEYSVWLSN

SEQ ID NO: 3742 - protein, 19 aa, Homo sapiens
GYYWSWIRQPPGKGEEWIG

SEQ ID NO: 3743 - protein, 9 aa, Homo sapiens
KGEQGEPGA

SEQ ID NO: 3744 - protein, 18 aa, Homo sapiens
VTWEVLEGEVEKEALKKI

SEQ ID NO: 3745 - protein, 26 aa, Homo sapiens
AGAARDALQGFKITQNNAMKISFAKK

SEQ ID NO: 3746 - protein, 20 aa, Homo sapiens
ANNGNLQLRNKEVTWEVLEG

SEQ ID NO: 3747 - protein, 21 aa, Homo sapiens
DGYVWQVTDMNRLHRFLCFGS

SEQ ID NO: 3748 - protein, 15 aa, Bos taurus
DVVYALKRQGRTLYG

SEQ ID NO: 3749 - protein, 18 aa, Bos taurus
DVVYALKRQGRTLYGFGG

SEQ ID NO: 3750 - protein, 13 aa, Artemia franciscana
EEEDEDMGFGLFD

SEQ ID NO: 3751 - protein, 22 aa, Homo sapiens
ELYKEKALSVETEKLLKYLEAV

SEQ ID NO: 3752 - protein, 24 aa, Homo sapiens
EPAVYFKEQFLDGDGWTSRWIESK

SEQ ID NO: 3753 - protein, 15 aa, Bos taurus
GITKPAIRRLARRGG

SEQ ID NO: 3754 - protein, 23 aa, Homo sapiens
GRGRGRGRGRGRGRGRGRGGPRR

SEQ ID NO: 3755 - protein, 16 aa, Homo sapiens
GSGKGKVQFQGKKTKF

SEQ ID NO: 3756 - protein, 17 aa, Homo sapiens
KALSVETEKLLKYLEAV

SEQ ID NO: 3757 - protein, 24 aa, Homo sapiens
KLIVCGMTSNGFTIADPDDRGMLD

SEQ ID NO: 3758 - protein, 24 aa, Homo sapiens
KMTLKNREPVQLETLSIRGNRIRY

SEQ ID NO: 3759 - protein, 15 aa, Homo sapiens
KPKAAKPKKAAAKKK

SEQ ID NO: 3760 - protein, 11 aa, Homo sapiens
MAVPETRPNHT

SEQ ID NO: 3761 - protein, 23 aa, Homo sapiens
MEESVNQMQPLNEKQIANSQDGY

SEQ ID NO: 3762 - protein, 20 aa, Homo sapiens
MKLVRFLMKLSHETVTIELK

SEQ ID NO: 3763 - protein, 17 aa, Enterovirus A
MVTSTITEKLLKNLVKI

SEQ ID NO: 3764 - protein, 10 aa, Homo sapiens
NGWSHKDLLR

SEQ ID NO: 3765 - protein, 7 aa, Homo sapiens
PPGMRPP

SEQ ID NO: 3766 - protein, 21 aa, Mus musculus
PTRAETREERMERKRREKIER

SEQ ID NO: 3767 - protein, 11 aa, Homo sapiens
PTRAPSGPRPP

SEQ ID NO: 3768 - protein, 21 aa, Mus musculus
RIHMVYSKRSGKPRGYAFIEY

SEQ ID NO: 3769 - protein, 21 aa, Mus musculus
RIHMVYSKRSGKPRGYAFIEY

SEQ ID NO: 3770 - protein, 20 aa, Homo sapiens
RPDAEYWNSQKDLLEQKRGR

SEQ ID NO: 3771 - protein, 20 aa, Homo sapiens
RPDAEYWNSQKDLLEQRRAA

SEQ ID NO: 3772 - protein, 11 aa, Homo sapiens
RRREGPDRSPR

SEQ ID NO: 3773 - protein, 29 aa, Bos taurus
SGRGKGGKGLGKGGAKRHRKVLRDNIQGI

SEQ ID NO: 3774 - protein, 24 aa, Homo sapiens
SQFGQILDILVSRSLKMRGQAFVI

SEQ ID NO: 3775 - protein, 15 aa, Homo sapiens
TGALDVIRNFTLDMI

SEQ ID NO: 3776 - protein, 18 aa, Bos taurus
TKPAIRRLARRGGVKRIS

SEQ ID NO: 3777 - protein, 22 aa, Homo sapiens
TKYKQRNGWSHKDLLRLSHLKP

SEQ ID NO: 3778 - protein, 20 aa, Homo sapiens
TLHKAFKGSIFVVFDSIESA

SEQ ID NO: 3779 - protein, 21 aa, Homo sapiens
VCEKLCNEKLLKKARIHPFHI

SEQ ID NO: 3780 - protein, 37 aa, Homo sapiens; identical to SEQ ID NO: 3149

SEQ ID NO: 3781 - protein, 15 aa, Homo sapiens
VSKDDSIISSLDVTD

SEQ ID NO: 3782 - protein, 20 aa, Mus musculus
YDERPGPSPLPHRDRDRDRE

SEQ ID NO: 3783 - protein, 21 aa, Mus musculus
YLPPLEKLPHEKHHNQPYCGI

SEQ ID NO: 3784 - protein, 15 aa, Homo sapiens
AARGRGRGMGRGNIF

SEQ ID NO: 3785 - protein, 15 aa, Homo sapiens
AARGRGRGMGRGNIF

SEQ ID NO: 3786 - protein, 15 aa, Homo sapiens
AIALREYRKKMDIPA

SEQ ID NO: 3787 - protein, 20 aa, Homo sapiens
AIVTKYITKGWKEVHELYKE

SEQ ID NO: 3788 - protein, 20 aa, Homo sapiens
ANNGNLQLRNKEVTWEVLEG

SEQ ID NO: 3789 - protein, 15 aa, Homo sapiens
ARGRGRGMGRGNIFQ

SEQ ID NO: 3790 - protein, 3 aa, Homo sapiens
CVP

SEQ ID NO: 3791 - protein, 6 aa, Homo sapiens
DGQFCH

SEQ ID NO: 3792 - protein, 20 aa, Homo sapiens
DLLRLSHLKPSSEGLAIVTK

SEQ ID NO: 3793 - protein, 15 aa, Homo sapiens
DVEPKVKSKKREAVA

SEQ ID NO: 3794 - protein, 15 aa, Homo sapiens
DVEPKVKSKKREAVA

SEQ ID NO: 3795 - protein, 15 aa, Homo sapiens
EAVAGRGRGRGRGRG

SEQ ID NO: 3796 - protein, 18 aa, Homo sapiens
EKALSVETEKLLKYLEAV

SEQ ID NO: 3797 - protein, 13 aa, Homo sapiens
ERDRKREKRKPKS

SEQ ID NO: 3798 - protein, 8 aa, Homo sapiens
GQIPPGAM

SEQ ID NO: 3799 - protein, 15 aa, Homo sapiens
GRGRGMGRGNIFQKR

SEQ ID NO: 3800 - protein, 13 aa, Homo sapiens
GRGRGRGRGGPRR

SEQ ID NO: 3801 - protein, 15 aa, Homo sapiens
GRGRGRGRGRGGPRR

SEQ ID NO: 3802 - protein, 15 aa, Homo sapiens
GRGRGRGRGRGGPRR

SEQ ID NO: 3803 - protein, 13 aa, Homo sapiens
GRGRGRGRGRGRG

SEQ ID NO: 3804 - protein, 15 aa, Homo sapiens
GRGRGRGRGRGRGGP

SEQ ID NO: 3805 - protein, 15 aa, Homo sapiens
GRGRGRGRGRGRGRG

SEQ ID NO: 3806 - protein, 13 aa, Homo sapiens
GRGTVAAAAAAAT

SEQ ID NO: 3807 - protein, 16 aa, Homo sapiens
GSGKGKVQFQGKKTKF

SEQ ID NO: 3808 - protein, 12 aa, Homo sapiens
HMVYSKRSGKPR

SEQ ID NO: 3809 - protein, 27 aa, Homo sapiens
IPPGRGTPMGMPPPGMRPPPPGMRGLL

SEQ ID NO: 3810 - protein, 20 aa, Homo sapiens
KALSVETEKLLKYLEAVEKV

SEQ ID NO: 3811 - protein, 12 aa, Homo sapiens
KEEGSRSNLGWL

SEQ ID NO: 3812 - protein, 12 aa, Mus musculus
KFKGKATLTSDK

SEQ ID NO: 3813 - protein, 15 aa, Homo sapiens
KREAVAGRGRGRGRG

SEQ ID NO: 3814 - protein, 20 aa, Homo sapiens
KRTKDELEVIHLIEEHRLVR

SEQ ID NO: 3815 - protein, 13 aa, Homo sapiens
KVKSKKREAVAGR

SEQ ID NO: 3816 - protein, 15 aa, Homo sapiens
LDGPTYKRRLDECEE

SEQ ID NO: 3817 - protein, 13 aa, Homo sapiens
LKAVKMTLKNREP

SEQ ID NO: 3818 - protein, 15 aa, Homo sapiens
LKYYLAPKIEDEEGS

SEQ ID NO: 3819 - protein, 39 aa, Homo sapiens
MFEARLVQGSILKKVLEALKDLINEACWDISSSGVNLQS

SEQ ID NO: 3820 - protein, 13 aa, Homo sapiens
NTHLKAVKMTLKN

SEQ ID NO: 3821 - protein, 12 aa, Homo sapiens
NWHQLHGKKEAY

SEQ ID NO: 3822 - protein, 13 aa, Bos taurus
PEPAKSAPAPKKG

SEQ ID NO: 3823 - protein, 25 aa, Bos taurus
PEPAKSAPAPKKGSKKAVTKAQKKD

SEQ ID NO: 3824 - protein, 7 aa, Simian virus 40
PKKKRKV

SEQ ID NO: 3825 - protein, 15 aa, Homo sapiens
PKVKSKKREAVAGRG

SEQ ID NO: 3826 - protein, 15 aa, Homo sapiens
PKVKSKKREAVAGRG

SEQ ID NO: 3827 - protein, 35 aa, Homo sapiens
PKVKSKKREAVAGRGRGRGRGRGRGRGRGRGGPRR

SEQ ID NO: 3828 - protein, 12 aa, Homo sapiens
QGFPFYDKPMRI

SEQ ID NO: 3829 - protein, 15 aa, Homo sapiens
QVAARGRGRGMGRGN

SEQ ID NO: 3830 - protein, 6 aa, Homo sapiens
QVKGFV

SEQ ID NO: 3831 - protein, 40 aa, Homo sapiens
QYPPGRGGPPPPMGRGAPPPGMMGPPPGMRPPMGPPMGIP

SEQ ID NO: 3832 - protein, 12 aa, Homo sapiens
RCRLCDEGHGLE

SEQ ID NO: 3833 - protein, 13 aa, Homo sapiens
REAVAGRGRGRGR

SEQ ID NO: 3834 - protein, 15 aa, Homo sapiens
RGRGMGRGNIFQKRR

SEQ ID NO: 3835 - protein, 15 aa, Homo sapiens
RGRGRGMGRGNIFQK

SEQ ID NO: 3836 - protein, 13 aa, Homo sapiens
RGRGRGRGRGRGG

SEQ ID NO: 3837 - protein, 13 aa, Homo sapiens
RGRGRGRGRGRGR

SEQ ID NO: 3838 - protein, 13 aa, Homo sapiens
SKKREAVAGRGRG

SEQ ID NO: 3839 - protein, 15 aa, Homo sapiens
SKKREAVAGRGRGRG

SEQ ID NO: 3840 - protein, 22 aa, Homo sapiens
TKYKQRNGWSHKDLLRLSHLKP

SEQ ID NO: 3841 - protein, 22 aa, Homo sapiens
TKYKQRNGWSHKDLLRLSHLKP

SEQ ID NO: 3842 - protein, 12 aa, Homo sapiens
TVETQNLEGLHH

SEQ ID NO: 3843 - protein, 15 aa, Homo sapiens
VAARGRGRGMGRGNI

SEQ ID NO: 3844 - protein, 13 aa, Homo sapiens
VAGRGRGRGRGRG

SEQ ID NO: 3845 - protein, 15 aa, Homo sapiens
VAGRGRGRGRGRGRG

SEQ ID NO: 3846 - protein, 25 aa, Homo sapiens
VAGRGRGRGRGRGRGRGRGRGGPRR

SEQ ID NO: 3847 - protein, 6 aa, Homo sapiens
VCEHCD

SEQ ID NO: 3848 - protein, 35 aa, Homo sapiens
VEPKVKKREAVAGRGRGRGRGRGRGRGRGRGGPRR

SEQ ID NO: 3849 - protein, 13 aa, Homo sapiens
VEPKVKSKKREAV

SEQ ID NO: 3850 - protein, 15 aa, Homo sapiens
VEPKVKSKKREAVAG

SEQ ID NO: 3851 - protein, 15 aa, Homo sapiens
VEPKVKSKKREAVAG

SEQ ID NO: 3852 - protein, 15 aa, Homo sapiens
VKSKKREAVAGRGRG

SEQ ID NO: 3853 - protein, 15 aa, Homo sapiens
VKSKKREAVAGRGRG

SEQ ID NO: 3854 - protein, 11 aa, Homo sapiens
VLVDVERGRTV

SEQ ID NO: 3855 - protein, 13 aa, Homo sapiens
VSMNTHLKAVKMT

SEQ ID NO: 3856 - protein, 9 aa, Homo sapiens
YITTIAGVM

SEQ ID NO: 3857 - protein, 20 aa, Homo sapiens
YKQRNGWSHKDLLRLSHLKP

SEQ ID NO: 3858 - protein, 609 aa, Homo sapiens
MSGWESYYKTEGDEEAEEEQEENLEASGDYKYSGRDSLIFLVDASKAMFESQSEDELTPFDMSIQCIQSVYISKIISSDRDLLAVVFYGTEKDKNSVNFKNIYVLQELDNPGAKRILELDQFKGQQGQKRFQDMMGHGSDYSLSEVLWVCANLFSDVQFKMSHKRIMLFTNEDNPHGNDSAKASRARTKAGDLRDTGIFLDLMHLKKPGGFDISLFYRDIISIAEDEDLRVHFEESSKLEDLLRKVRAKETRKRALSRLKLKLNKDIVISVGIYNLVQKALKPPPIKLYRETNEPVKTKTRTFNTSTGGLLLPSDTKRSQIYGSRQIILEKEETEELKRFDDPGLMLMGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPMLKEACRAYGLKSGLKKQELLEALTKHFQD

SEQ ID NO: 3859 - protein, 119 aa, Homo sapiens
MKLVRFLMKLSHETVTIELKNGTQVHGTITGVDVSMNTHLKAVKMTLKNREPVQLETLSIRGNNIRYFILPDSLPLDTLLVDVEPKVKSKKREAVAGRGRGRGRGRGRGRGRGRGGPRR

SEQ ID NO: 3860 - protein, 10 aa, Homo sapiens
AAFYKTFKTV

SEQ ID NO: 3861 - protein, 15 aa, Homo sapiens
AEMKSLEEKIGCLLK

SEQ ID NO: 3862 - protein, 11 aa, Homo sapiens
ALLRNLGKMTA

SEQ ID NO: 3863 - protein, 14 aa, Homo sapiens
ALREYRKKMDIPAK

SEQ ID NO: 3864 - protein, 9 aa, Homo sapiens
AMKISFAKK

SEQ ID NO: 3865 - protein, 7 aa, Homo sapiens
APGMRPP

SEQ ID NO: 3866 - protein, 10 aa, Homo sapiens
APPPGMRPPM

SEQ ID NO: 3867 - protein, 19 aa, Mus musculus
APQGSLGEYLFERLTLKHD

SEQ ID NO: 3868 - protein, 15 aa, Homo sapiens
ATLDDIKEWLEDKGQ

SEQ ID NO: 3869 - protein, 14 aa, Homo sapiens
CSLPMIWAQKTNTP

SEQ ID NO: 3870 - protein, 9 aa, Homo sapiens
DRNGTHLDA

SEQ ID NO: 3871 - protein, 20 aa, Mus musculus
DSCPLDCKVYVGNLGNNGNK

SEQ ID NO: 3872 - protein, 9 aa, Homo sapiens
EALTKHFQD

SEQ ID NO: 3873 - protein, 14 aa, Homo sapiens
EAVEKVKRTKDELE

SEQ ID NO: 3874 - protein, 14 aa, Homo sapiens
EKVKRTKDELEVIH

SEQ ID NO: 3875 - protein, 15 aa, Homo sapiens
EQEAKQKLEEDAEMK

SEQ ID NO: 3876 - protein, 50 aa, Homo sapiens
FNGTFVKLNKASINMLRIVEPYIAWGYPNLKSVNELIYKRGYGKINKKRI

SEQ ID NO: 3877 - protein, 30 aa, Homo sapiens
GDAFKTLFVARVNYDTTESKLRREFEVYGP

SEQ ID NO: 3878 - protein, 21 aa, Homo sapiens
GIIDLIEKRKFNQNSNSTYCV

SEQ ID NO: 3879 - protein, 10 aa, Homo sapiens
GIMAPPPGMR

SEQ ID NO: 3880 - protein, 10 aa, Homo sapiens
GMRPPMGPPI

SEQ ID NO: 3881 - protein, 13 aa, Homo sapiens
GQILDILVSRSLK

SEQ ID NO: 3882 - protein, 20 aa, Mus musculus
HHNTLVCSVTDFYPAKIKVR

SEQ ID NO: 3883 - protein, 8 aa, Homo sapiens
HKAFKGSI

SEQ ID NO: 3884 - protein, 8 aa, Homo sapiens
HKGFKGVD

SEQ ID NO: 3885 - protein, 16 aa, Homo sapiens
HLLTNHLKSKEVWKAL

SEQ ID NO: 3886 - protein, 20 aa, Mus musculus
HLQLAIRNDEELNKLLGKVT

SEQ ID NO: 3887 - protein, 18 aa, Mus musculus
HPPHIEIQMLKNGKKIPK

SEQ ID NO: 3888 - protein, 9 aa, Homo sapiens
IIAKMKGTF

SEQ ID NO: 3889 - protein, 10 aa, Homo sapiens
IMAPPPGMRP

SEQ ID NO: 3890 - protein, 15 aa, Homo sapiens
KFVETPGQKYKETDL

SEQ ID NO: 3891 - protein, 11 aa, Homo sapiens
KIKKDELKKSL

SEQ ID NO: 3892 - protein, 15 aa, Homo sapiens
LAVTKYKQRNGWSHK

SEQ ID NO: 3893 - protein, 40 aa, Homo sapiens
LEKDEREQLRILGEKEAKLAQQSQALQELISELDRRCHSS

SEQ ID NO: 3894 - protein, 9 aa, Homo sapiens
LKRVCAQIN

SEQ ID NO: 3895 - protein, 36 aa, Homo sapiens
LQELEKDEREQLRILGEKEAKLAQQSQALQELISEL

SEQ ID NO: 3896 - protein, 49 aa, Homo sapiens
LQELEKDEREQLRILGEKEAKLAQQSQALQELISELDRRCHSSALELLQ

SEQ ID NO: 3897 - protein, 9 aa, Homo sapiens
LRLSHLKPS

SEQ ID NO: 3898 - protein, 30 aa, Homo sapiens
LTLPKVEAMNKRLGSLVDEFKELVYPPDYN

SEQ ID NO: 3899 - protein, 8 aa, Homo sapiens
LYKEKALS

SEQ ID NO: 3900 - protein, 10 aa, Homo sapiens
MAPPPGMRPP

SEQ ID NO: 3901 - protein, 26 aa, Homo sapiens
MEGVEEKKKEVPAVPETLKKKRRNFA

SEQ ID NO: 3902 - protein, 12 aa, Homo sapiens
MGRGAPPPGMMG

SEQ ID NO: 3903 - protein, 9 aa, Homo sapiens
MKCGMWGRA

SEQ ID NO: 3904 - protein, 24 aa, Homo sapiens
MLRKARRKLIYEKAKHYHKEYRQM

SEQ ID NO: 3905 - protein, 10 aa, Homo sapiens
MRPPMGPPIG

SEQ ID NO: 3906 - protein, 11 aa, Homo sapiens
MWGRALRKAIA

SEQ ID NO: 3907 - protein, 14 aa, Homo sapiens
NEKLLKKARIHPFH

SEQ ID NO: 3908 - protein, 9 aa, Homo sapiens
NLNEKIKKD

SEQ ID NO: 3909 - protein, 10 aa, Homo sapiens
PGIMAPPPGM

SEQ ID NO: 3910 - protein, 10 aa, Homo sapiens
PGMRPPMGPP

SEQ ID NO: 3911 - protein, 20 aa, Mus musculus
PGVTVKDVNQQEFVRALAAF

SEQ ID NO: 3912 - protein, 10 aa, Homo sapiens
PPGMRPPMGP

SEQ ID NO: 3913 - protein, 8 aa, Homo sapiens
PPPGIRGP

SEQ ID NO: 3914 - protein, 7 aa, Homo sapiens
PPPGMRP

SEQ ID NO: 3915 - protein, 8 aa, Homo sapiens
PPPGMRPP

SEQ ID NO: 3916 - protein, 10 aa, Homo sapiens
PPPGMRPPMG

SEQ ID NO: 3917 - protein, 16 aa, Homo sapiens
QEMPLTALLRNLGKMT

SEQ ID NO: 3918 - protein, 9 aa, Homo sapiens
QETPATKKA

SEQ ID NO: 3919 - protein, 24 aa, Homo sapiens
RAYGLKSGLKKQELLEALTKHFQD

SEQ ID NO: 3920 - protein, 34 aa, Homo sapiens
RILELDQFKGQQGQKRFQDMMGHGSDYSLSEVLW

SEQ ID NO: 3921 - protein, 18 aa, Homo sapiens
RKGHFLLSSKSGFWTIWL

SEQ ID NO: 3922 - protein, 14 aa, Mus musculus
RMVNHFIAEFKRKH

SEQ ID NO: 3923 - protein, 15 aa, Mus musculus
RQVRFYDGVIELSLT

SEQ ID NO: 3924 - protein, 10 aa, Homo sapiens
RSGKPRGYAF

SEQ ID NO: 3925 - protein, 10 aa, Homo sapiens
RSLKMRGQAF

SEQ ID NO: 3926 - protein, 11 aa, Homo sapiens
SDDDMGFGLFD

SEQ ID NO: 3927 - protein, 12 aa, Homo sapiens
SEEELKTHISKG

SEQ ID NO: 3928 - protein, 50 aa, Homo sapiens
SEEELKTHISKGTLGKFTVPMLKEACRAYGLKSGLKKQELLEALTKHFQD

SEQ ID NO: 3929 - protein, 9 aa, Homo sapiens
SQEGRTTKQ

SEQ ID NO: 3930 - protein, 21 aa, Homo sapiens
SRIHAEFVQQKNFLVEEEQRQ

SEQ ID NO: 3931 - protein, 10 aa, Homo sapiens
STKQAAFKAV

SEQ ID NO: 3932 - protein, 8 aa, Homo sapiens
TEKLLKYL

SEQ ID NO: 3933 - protein, 12 aa, Homo sapiens
TFIQFKKDLKES

SEQ ID NO: 3934 - protein, 11 aa, Homo sapiens
TYYIKEQKLGL

SEQ ID NO: 3935 - protein, 9 aa, Homo sapiens
VEPTGKRFL

SEQ ID NO: 3936 - protein, 19 aa, Mus musculus
VFRRYVEVGRVAYISFSPH

SEQ ID NO: 3937 - protein, 12 aa, Homo sapiens
VGRATPPPGIMA

SEQ ID NO: 3938 - protein, 21 aa, Homo sapiens
VSLVCEEKLCNEKLLKKARIH

SEQ ID NO: 3939 - protein, 13 aa, Homo sapiens
VTKYITKGWKEVH

SEQ ID NO: 3940 - protein, 17 aa, Mus musculus
VVKKGTDFQLNQLEGKK

SEQ ID NO: 3941 - protein, 15 aa, Homo sapiens
YKTGHGLRGKLKWRP

SEQ ID NO: 3942 - protein, 8 aa, Homo sapiens
AAAAAPAK

SEQ ID NO: 3943 - protein, 22 aa, Mus musculus
AGRGRGRGRGRGRGRGRGRGSL

SEQ ID NO: 3944 - protein, 22 aa, Homo sapiens
AKVEAKEESEESDEDMGFGLFD

SEQ ID NO: 3945 - protein, 15 aa, Homo sapiens
ALGGNSSPSAKDIKK

SEQ ID NO: 3946 - protein, 15 aa, Homo sapiens
APAAGSAPAAAEEKK

SEQ ID NO: 3947 - protein, 24 aa, Homo sapiens
AVHGERLHLFCEKDGKALCWVCAQ

SEQ ID NO: 3948 - protein, 16 aa, Homo sapiens
CAFTGPLRPFFSPGFN

SEQ ID NO: 3949 - protein, 15 aa, Homo sapiens
CHSSALELLQEVIIV

SEQ ID NO: 3950 - protein, 15 aa, Homo sapiens
DDRLNKVISELNGKN

SEQ ID NO: 3951 - protein, 15 aa, Homo sapiens
DEKKEESEESDDDMG

SEQ ID NO: 3952 - protein, 8 aa, Homo sapiens
DMGFGLFD

SEQ ID NO: 3953 - protein, 16 aa, Homo sapiens
ECISQVGKGGGSVCAV

SEQ ID NO: 3954 - protein, 24 aa, Homo sapiens
EEVTCPICLDPFVEPVSIECGHSF

SEQ ID NO: 3955 - protein, 15 aa, Homo sapiens
ESEESDDDMGFGLFD

SEQ ID NO: 3956 - protein, 16 aa, Homo sapiens
FHSGKHYWEVDVTGKE

SEQ ID NO: 3957 - protein, 15 aa, Unknown
  epitope involved in systemic lupus
FIEWNKLRFRQGLEW

SEQ ID NO: 3958 - protein, 13 aa, Unknown
  epitope involved in systemic lupus
GGGRDRDRDRGGG

SEQ ID NO: 3959 - protein, 8 aa, Homo sapiens
GIARVPLA

SEQ ID NO: 3960 - protein, 15 aa, Homo sapiens
GIEADDDRLNKVISE

SEQ ID NO: 3961 - protein, 16 aa, Homo sapiens
GKALCWVCAQSRKHRD

SEQ ID NO: 3962 - protein, 20 aa, Homo sapiens
GKALCWVCAQSRKHRDHAMV

SEQ ID NO: 3963 - protein, 23 aa, Homo sapiens
GKKKSKPVNKDRYISKMFLRGDS

SEQ ID NO: 3964 - protein, 15 aa, Human Endogenous Retrovirus
GKTCPKEIPKGSKNT

SEQ ID NO: 3965 - protein, 16 aa, Homo sapiens
GLKKMLRTCAVHITLD

SEQ ID NO: 3966 - protein, 11 aa, Homo sapiens
GSIYNPEVLDI

SEQ ID NO: 3967 - protein, 8 aa, Homo sapiens
GVGGPSQQ

SEQ ID NO: 3968 - protein, 8 aa, Homo sapiens
GVGRAAGR

SEQ ID NO: 3969 - protein, 8 aa, Homo sapiens
GVPAGVPI

SEQ ID NO: 3970 - protein, 15 aa, Homo sapiens
IEDVIAQGIGKLASV

SEQ ID NO: 3971 - protein, 17 aa, Homo sapiens
IWLWNKQKYEAGTYPQT

SEQ ID NO: 3972 - protein, 23 aa, Homo sapiens
KAQVAARGRGRGMGRGNIFQKRR

SEQ ID NO: 3973 - protein, 15 aa, Homo sapiens
KDIKKILDSVGIEAD

SEQ ID NO: 3974 - protein, 18 aa, Homo sapiens
KEISQEAREGTQGERCAV

SEQ ID NO: 3975 - protein, 15 aa, Homo sapiens
LNGKNIEDVIAQGIG

SEQ ID NO: 3976 - protein, 16 aa, Homo sapiens
LSEDRRQVRLGDTQQS

SEQ ID NO: 3977 - protein, 13 aa, Homo sapiens
MASAARLTMMWEE

SEQ ID NO: 3978 - protein, 31 aa, Homo sapiens
MLKNAPMLKSMKNKNQGSGAGRGKAAILKAQ

SEQ ID NO: 3979 - protein, 8 aa, Homo sapiens
MMRKAIRG

SEQ ID NO: 3980 - protein, 13 aa, Homo sapiens
MSLLNKPKSEMTP

SEQ ID NO: 3981 - protein, 17 aa, Homo sapiens
NITDHGSLIYSFSECAF

SEQ ID NO: 3982 - protein, 21 aa, Homo sapiens
NSQDGYVWQVTDMNRLHRFLC

SEQ ID NO: 3983 - protein, 15 aa, Homo sapiens
PAGGAVAVSAAPGSA

SEQ ID NO: 3984 - protein, 8 aa, Homo sapiens
PAPGMRPP

SEQ ID NO: 3985 - protein, 18 aa, Mus musculus
PEPAKSAPAPKKGSKKAV

SEQ ID NO: 3986 - protein, 18 aa, Mus musculus
PEPAKSAPAPKKGSKKAV

SEQ ID NO: 3987 - protein, 49 aa, Mus musculus; identical to SEQ ID NO: 3159

SEQ ID NO: 3988 - protein, 7 aa, Homo sapiens
PPGIRGP

SEQ ID NO: 3989 - protein, 8 aa, Homo sapiens
PPPGMIPP

SEQ ID NO: 3990 - protein, 8 aa, Homo sapiens
PPPGMRGP

SEQ ID NO: 3991 - protein, 19 aa, Homo sapiens
PQTPLHLQVPPCQVGIFLD

SEQ ID NO: 3992 - protein, 13 aa, Homo sapiens
QALGITTKISRGT

SEQ ID NO: 3993 - protein, 9 aa, Homo sapiens
QVYIRGSKI

SEQ ID NO: 3994 - protein, 8 aa, Homo sapiens
RATWKSNY

SEQ ID NO: 3995 - protein, 15 aa, Homo sapiens
RDMLLANKVPAAARA

SEQ ID NO: 3996 - protein, 11 aa, Homo sapiens
RDRDRDRDRDR

SEQ ID NO: 3997 - protein, 8 aa, Homo sapiens
RDRDRDRE

SEQ ID NO: 3998 - protein, 8 aa, Homo sapiens
RNPLIAGK

SEQ ID NO: 3999 - protein, 13 aa, Bos taurus
SAPAPKKGSKKAV

SEQ ID NO: 4000 - protein, 17 aa, Homo sapiens
SPGFNDGGKNTAPLTLC

SEQ ID NO: 4001 - protein, 17 aa, Homo sapiens
SQALQELISELDRRCHS

SEQ ID NO: 4002 - protein, 15 aa, Homo sapiens
SSPSAKDIKKILDSV

SEQ ID NO: 4003 - protein, 12 aa, Homo sapiens
SVLTQSVKNNTQ

SEQ ID NO: 4004 - protein, 15 aa, Homo sapiens
SVSYDDWDYSLEARV

SEQ ID NO: 4005 - protein, 14 aa, Homo sapiens
TGEVYRGKLIEAED

SEQ ID NO: 4006 - protein, 15 aa, Homo sapiens
VAVSAAPGSAAPAAG

SEQ ID NO: 4007 - protein, 15 aa, Homo sapiens [sequence omitted]

SEQ ID NO: 4008 - protein, 16 aa, Homo sapiens
VHGERLHLFCEKDGKA

SEQ ID NO: 4009 - protein, 11 aa, Homo sapiens
WTEVPKSGKGK

SEQ ID NO: 4010 - protein, 17 aa, Homo sapiens
YQEKLQVALGELRRKQE

SEQ ID NO: 4011 - protein, 14 aa, Homo sapiens
AETREERMERKRRE

SEQ ID NO: 4012 - protein, 9 aa, Homo sapiens
AFQQGKIPP

SEQ ID NO: 4013 - protein, 22 aa, Homo sapiens
AKGKPDAAKKGVVKAEKSKKKK

SEQ ID NO: 4014 - protein, 20 aa, Homo sapiens
EEASGSSVTAEEAKKFLAPK

SEQ ID NO: 4015 - protein, 8 aa, Homo sapiens
GMMPAPHM

SEQ ID NO: 4016 - protein, 9 aa, Homo sapiens
GPAPGMRPP

SEQ ID NO: 4017 - protein, 9 aa, Homo sapiens
GPPMMRPPA

SEQ ID NO: 4018 - protein, 10 aa, Homo sapiens
GPPRPGMMPA

SEQ ID NO: 4019 - protein, 8 aa, Homo sapiens
HDSPSVRK

SEQ ID NO: 4020 - protein, 8 aa, Homo sapiens
KDYYQKWM

SEQ ID NO: 4021 - protein, 8 aa, Homo sapiens
KIPPTPFS

SEQ ID NO: 4022 - protein, 30 aa, Homo sapiens
LALVFEAPNQEKVSDYEMKLMDLDVEQLGI

SEQ ID NO: 4023 - protein, 7 aa, Homo sapiens
MERKRRE

SEQ ID NO: 4024 - protein, 8 aa, Homo sapiens
PFSAPPPA

SEQ ID NO: 4025 - protein, 7 aa, Human herpesvirus
PPPGRRP

SEQ ID NO: 4026 - protein, 9 aa, Homo sapiens
PPPPGMMPV

SEQ ID NO: 4027 - protein, 8 aa, Homo sapiens
PPPPSLPG

SEQ ID NO: 4028 - protein, 32 aa, Homo sapiens
RERRRSHRSERERRRDRDRDRDRDREHKRGER

SEQ ID NO: 4029 - protein, 10 aa, Homo sapiens
RKTHCSGRKH

SEQ ID NO: 4030 - protein, 10 aa, Homo sapiens
TRPGMTRPDR

SEQ ID NO: 4031 - protein, 20 aa, Mus musculus
YYCARFLWEPYAMDYWGQGS

SEQ ID NO: 4032 - protein, 34 aa, Homo sapiens
AVAATASIAGAPTQYPPGRGTPPPPVGRATPPPG

SEQ ID NO: 4033 - protein, 13 aa, Homo sapiens
GIMAPPPGMRPPM

SEQ ID NO: 4034 - protein, 22 aa, Homo sapiens
GVGGPSQQVMTPQGRGTVAAAA

SEQ ID NO: 4035 - protein, 11 aa, Homo sapiens
MGPPIGLPPAR

SEQ ID NO: 4036 - protein, 32 aa, Homo sapiens
RGTPIGMPPPGMRPPPPGIRGPPPPGMRPPRP

SEQ ID NO: 4037 - protein, 20 aa, Homo sapiens
EALKKIIEDQQESLNKWKSK

SEQ ID NO: 4038 - protein, 20 aa, Homo sapiens
ETPGQKYKETDLLILFKDDY

SEQ ID NO: 4039 - protein, 20 aa, Homo sapiens
FSNHGEIKWIDFVRGAKEGI

SEQ ID NO: 4040 - protein, 6 aa, Homo sapiens
GLELPE

SEQ ID NO: 4041 - protein, 20 aa, Homo sapiens
HPMLPNYKNFKGTIQELGQN

SEQ ID NO: 4042 - protein, 6 aa, Bos taurus
IRGERA

SEQ ID NO: 4043 - protein, 4 aa, Homo sapiens
KIRY

SEQ ID NO: 4044 - protein, 4 aa, Homo sapiens
KKIK

SEQ ID NO: 4045 - protein, 4 aa, Homo sapiens
KNDK

SEQ ID NO: 4046 - protein, 4 aa, Homo sapiens
LDKK

SEQ ID NO: 4047 - protein, 20 aa, Homo sapiens
LILFKDDYFAKKNEERKQNK

SEQ ID NO: 4048 - protein, 12 aa, Homo sapiens
NGNLQLRNKEVT

SEQ ID NO: 4049 - protein, 5 aa, Homo sapiens
PIVET

SEQ ID NO: 4050 - protein, 7 aa, Homo sapiens
QFIGYPI

SEQ ID NO: 4051 - protein, 20 aa, Homo sapiens
SDYKSAHKGFKGVDAQGTLS

SEQ ID NO: 4052 - protein, 5 aa, Homo sapiens
SKEQV

SEQ ID NO: 4053 - protein, 20 aa, Homo sapiens
VRGAKEGIILFKEKAKEALG

SEQ ID NO: 4054 - protein, 10 aa, Homo sapiens
EWEDTYGIVL

SEQ ID NO: 4055 - protein, 10 aa, Staphylococcus aureus
EWESTYSILG

SEQ ID NO: 4056 - protein, 50 aa, Homo sapiens; identical to SEQ ID NO: 3165

SEQ ID NO: 4057 - protein, 23 aa, Homo sapiens
KMLKNREPVQLETLSIRGNRIRY

SEQ ID NO: 4058 - protein, 10 aa, Human herpesvirus
LWDQTYGVPD

SEQ ID NO: 4059 - protein, 25 aa, Homo sapiens
PAVPETLKKKRRNFAELKIKRLRKK

SEQ ID NO: 4060 - protein, 19 aa, Homo sapiens
RMARMARKAGNFYVPAEPK

SEQ ID NO: 4061 - protein, 10 aa, Human immunodeficiency virus
TWNDTYGSNN

SEQ ID NO: 4062 - protein, 10 aa, Homo sapiens
TYGIVLLSGV

SEQ ID NO: 4063 - protein, 14 aa, Bos taurus
ALQEACEAYLVGLF

SEQ ID NO: 4064 - protein, 11 aa, Trypanosoma cruzi
EDDDMGFGLFD

SEQ ID NO: 4065 - protein, 21 aa, Homo sapiens
GGGGGGSGGGGSGGGGGGGSS

SEQ ID NO: 4066 - protein, 18 aa, Bos taurus
RFQSSAVMALQEACEAYL

SEQ ID NO: 4067 - protein, 11 aa, Homo sapiens
TFIQFKKDLKE

SEQ ID NO: 4068 - protein, 21 aa, Bos taurus
ARTKQTARKSTGGKAPRKQLA

SEQ ID NO: 4069 - protein, 16 aa, Bos taurus
AVTYTEHAKRKTVTAM

SEQ ID NO: 4070 - protein, 18 aa, Bos taurus
GAGAPVYLAAVLEYLTAE

SEQ ID NO: 4071 - protein, 7 aa, Escherichia coli
ILPPPGY

SEQ ID NO: 4072 - protein, 20 aa, Bos taurus
IQTAVRLLLPGELAKHAVSE

SEQ ID NO: 4073 - protein, 15 aa, Bos taurus
KQLATKAARKSAPAT

SEQ ID NO: 4074 - protein, 21 aa, Bos taurus
LAGNAARDNKKTRIIPRHLQL

SEQ ID NO: 4075 - protein, 16 aa, Bos taurus
LAIRNDEELNKLLGKV

SEQ ID NO: 4076 - protein, 14 aa, Bos taurus
LPKKTESHHKAKGK

SEQ ID NO: 4077 - protein, 15 aa, Bos taurus
MSGRGKQGGKARAKA

SEQ ID NO: 4078 - protein, 16 aa, Bos taurus
PATGGVKKPHRYRPGT

SEQ ID NO: 4079 - protein, 16 aa, Bos taurus
RYRPGTVALREIRRYQ

SEQ ID NO: 4080 - protein, 7 aa, Mus musculus
SPLNVLM

SEQ ID NO: 4081 - protein, 7 aa, Human herpesvirus
SPPEWLK

SEQ ID NO: 4082 - protein, 16 aa, Bos taurus
VHPDTGISSKAMGIMN

SEQ ID NO: 4083 - protein, 15 aa, Bos taurus
VSEGTKAVTKYTSSK

SEQ ID NO: 4084 - protein, 8 aa, Homo sapiens
ADGKKIDG

SEQ ID NO: 4085 - protein, 8 aa, Homo sapiens
AIALREYR

SEQ ID NO: 4086 - protein, 8 aa, Homo sapiens
AICSQCSD

SEQ ID NO: 4087 - protein, 8 aa, Unknown
  epitope involved in systemic lupus
AKAKAKAK

SEQ ID NO: 4088 - protein, 16 aa, Homo sapiens
ALAVTKYKQRNGWSHK

SEQ ID NO: 4089 - protein, 8 aa, Homo sapiens
ALFAPRDP

SEQ ID NO: 4090 - protein, 10 aa, Homo sapiens
ASAARLTMMW

SEQ ID NO: 4091 - protein, 11 aa, Homo sapiens
AVEKVKRTKDE

SEQ ID NO: 4092 - protein, 16 aa, Homo sapiens
DVEPKVKSKKREAVAG

SEQ ID NO: 4093 - protein, 22 aa, Homo sapiens
EKDSYVVAFSDEMVPCPVTTDM

SEQ ID NO: 4094 - protein, 10 aa, Homo sapiens
ERMERKRREK

SEQ ID NO: 4095 - protein, 15 aa, Homo sapiens
FTFIQFKKDLKESMK

SEQ ID NO: 4096 - protein, 8 aa, Homo sapiens
GTQVHGTI

SEQ ID NO: 4097 - protein, 8 aa, Homo sapiens
HPAIALRE

SEQ ID NO: 4098 - protein, 8 aa, Homo sapiens
IALREYRK

SEQ ID NO: 4099 - protein, 8 aa, Homo sapiens
ILPDSLPL

SEQ ID NO: 4100 - protein, 15 aa, Homo sapiens
KDKDRDRKRRSSRSR

SEQ ID NO: 4101 - protein, 8 aa, Unknown
  epitope involved in systemic lupus
KKAKAKAK

SEQ ID NO: 4102 - protein, 15 aa, Homo sapiens
KKAPAKKGEKVPKGK

SEQ ID NO: 4103 - protein, 4 aa, Unknown
  epitope involved in systemic lupus
KKKK

SEQ ID NO: 4104 - protein, 16 aa, Homo sapiens
LCNEKLLKKARIHPFH

SEQ ID NO: 4105 - protein, 16 aa, Homo sapiens
LFKPPKYHPDVPYVKR

SEQ ID NO: 4106 - protein, 8 aa, Homo sapiens
LLVDVEPK

SEQ ID NO: 4107 - protein, 12 aa, Homo sapiens
LPMIWAQKTNTP

SEQ ID NO: 4108 - protein, 15 aa, Homo sapiens
LRKFKNISYFPGKLR

SEQ ID NO: 4109 - protein, 8 aa, Homo sapiens
LTALLRNL

SEQ ID NO: 4110 - protein, 22 aa, Homo sapiens
MEESVNQMQPLNEKQIANSQDG

SEQ ID NO: 4111 - protein, 8 aa, Homo sapiens
MPLTALLR

SEQ ID NO: 4112 - protein, 14 aa, Homo sapiens
NTHLKAVKMTLKNR

SEQ ID NO: 4113 - protein, 8 aa, Homo sapiens
PAIALREY

SEQ ID NO: 4114 - protein, 8 aa, Homo sapiens
PLTALLRN

SEQ ID NO: 4115 - protein, 15 aa, Homo sapiens
QRRSARLSAKPAPPK

SEQ ID NO: 4116 - protein, 8 aa, Unknown
  epitope involved in systemic lupus
RARARARA

SEQ ID NO: 4117 - protein, 28 aa, Homo sapiens
REAVAGRGRGRGRGRGRGRGRGRGGPRR

SEQ ID NO: 4118 - protein, 8 aa, Homo sapiens
RFLMKLSH

SEQ ID NO: 4119 - protein, 8 aa, Unknown
  epitope involved in systemic lupus
RRARARAR

SEQ ID NO: 4120 - protein, 4 aa, Unknown
  epitope involved in systemic lupus
RRRR

SEQ ID NO: 4121 - protein, 8 aa, Homo sapiens
RRRSRERS

SEQ ID NO: 4122 - protein, 8 aa, Homo sapiens
RRSHRSER

SEQ ID NO: 4123 - protein, 8 aa, Homo sapiens
RRSRSRDK

SEQ ID NO: 4124 - protein, 8 aa, Homo sapiens
SEGLAIVT

SEQ ID NO: 4125 - protein, 17 aa, Homo sapiens
SKLIKIFQDHPLQKTYN

SEQ ID NO: 4126 - protein, 8 aa, Homo sapiens
SRERSKDK

SEQ ID NO: 4127 - protein, 8 aa, Homo sapiens
TALLRNLG

SEQ ID NO: 4128 - protein, 8 aa, Homo sapiens
TLKNREPV

SEQ ID NO: 4129 - protein, 16 aa, Homo sapiens
TYKTGHGLRGKLKWRP

SEQ ID NO: 4130 - protein, 8 aa, Homo sapiens
VERGRTVK

SEQ ID NO: 4131 - protein, 8 aa, Homo sapiens
VHPAIALR

SEQ ID NO: 4132 - protein, 8 aa, Homo sapiens
VKGWRPRR

SEQ ID NO: 4133 - protein, 12 aa, Homo sapiens
VYSKRSGKPRGY

SEQ ID NO: 4134 - protein, 15 aa, Homo sapiens
YKHADGKKIDGRRVL

SEQ ID NO: 4135 - protein, 15 aa, Mus musculus
AKSAPAPKKGSKKAV

SEQ ID NO: 4136 - protein, 15 aa, Mus musculus
APAPKKGSKKAVTKA

SEQ ID NO: 4137 - protein, 15 aa, Bos taurus
AYLVGLFEDTNLCAI

SEQ ID NO: 4138 - protein, 15 aa, Mus musculus
DGKKRKRSRKESYSV

SEQ ID NO: 4139 - protein, 15 aa, Homo sapiens
FLENVIRDAVTYTEH

SEQ ID NO: 4140 - protein, 15 aa, Mus musculus
GGAKRHRKVLRDNIQ

SEQ ID NO: 4141 - protein, 15 aa, Mus musculus
GITKPAIRRIARRGG

SEQ ID NO: 4142 - protein, 15 aa, Homo sapiens
GKGGKGLGKGGAKRH

SEQ ID NO: 4143 - protein, 15 aa, Mus musculus
GKGLGKGGAKRHRKV

SEQ ID NO: 4144 - protein, 15 aa, Mus musculus
IMMSFVNDIFERIAG

SEQ ID NO: 4145 - protein, 15 aa, Mus musculus
IRRIARRGGVKRISG

SEQ ID NO: 4146 - protein, 15 aa, Mus musculus
ISGLIYEETRGVLKV

SEQ ID NO: 4147 - protein, 15 aa, Mus musculus
KPAIRRIARRGGVKR

SEQ ID NO: 4148 - protein, 24 aa, Mus musculus
KRHRKVLRDNIQGITKPAIRRIAR

SEQ ID NO: 4149 - protein, 15 aa, Mus musculus
LGKGGAKRHRKVLRD

SEQ ID NO: 4150 - protein, 15 aa, Mus musculus
LKVFLENVIRDAVTY

SEQ ID NO: 4151 - protein, 15 aa, Mus musculus
NDIFERIAGEASRLA

SEQ ID NO: 4152 - protein, 15 aa, Homo sapiens
NVIRDAVTYTEHAKR

SEQ ID NO: 4153 - protein, 15 aa, Mus musculus
PEPAKSAPAPKKGSK

SEQ ID NO: 4154 - protein, 24 aa, Mus musculus
PKKGSKKAVTKAQKKDGKKRKRSR

SEQ ID NO: 4155 - protein, 15 aa, Mus musculus
QKKDGKKRKRSRKES

SEQ ID NO: 4156 - protein, 15 aa, Mus musculus
RDAVTYTEHAKRKTV

SEQ ID NO: 4157 - protein, 15 aa, Mus musculus
RGVLKVFLENVIRDA

SEQ ID NO: 4158 - protein, 15 aa, Homo sapiens
SGRGKGGKGLGKGGA

SEQ ID NO: 4159 - protein, 15 aa, Mus musculus
SREIQTAVRLLLPGE

SEQ ID NO: 4160 - protein, 15 aa, Homo sapiens
YALKRQGRTLYGFGG

SEQ ID NO: 4161 - protein, 10 aa, Homo sapiens
AAFQQGKIPP

SEQ ID NO: 4162 - protein, 8 aa, Homo sapiens
AMPPQQLM

SEQ ID NO: 4163 - protein, 10 aa, Homo sapiens
APGMRPPMGG

SEQ ID NO: 4164 - protein, 8 aa, Homo sapiens
ATKKAVQG

SEQ ID NO: 4165 - protein, 8 aa, Homo sapiens
EVRLVPGR

SEQ ID NO: 4166 - protein, 10 aa, Homo sapiens
FQQGKIPPTP

SEQ ID NO: 4167 - protein, 8 aa, Homo sapiens
GAMPPQQL

SEQ ID NO: 4168 - protein, 8 aa, Homo sapiens
GMIPPPGL

SEQ ID NO: 4169 - protein, 8 aa, Homo sapiens
GMPPMTQA

SEQ ID NO: 4170 - protein, 10 aa, Homo sapiens
GPAPGMRPPM

SEQ ID NO: 4171 - protein, 8 aa, Homo sapiens
GQPPYMPP

SEQ ID NO: 4172 - protein, 8 aa, Homo sapiens
IGTFKAFD

SEQ ID NO: 4173 - protein, 8 aa, Homo sapiens
IPPGAMPP

SEQ ID NO: 4174 - protein, 8 aa, Homo sapiens
IPPPGLAP

SEQ ID NO: 4175 - protein, 8 aa, Homo sapiens
KPKSQETP

SEQ ID NO: 4176 - protein, 8 aa, Homo sapiens
MIPPPGLA

SEQ ID NO: 4177 - protein, 8 aa, Homo sapiens
MPPMTQAP

SEQ ID NO: 4178 - protein, 8 aa, Homo sapiens
MPPPGMIP

SEQ ID NO: 4179 - protein, 8 aa, Homo sapiens
MPPQQLMP

SEQ ID NO: 4180 - protein, 8 aa, Homo sapiens
MTQAPRIM

SEQ ID NO: 4181 - protein, 8 aa, Homo sapiens
PATKKAVQ

SEQ ID NO: 4182 - protein, 8 aa, Homo sapiens
PGAMPPQQ

SEQ ID NO: 4183 - protein, 8 aa, Homo sapiens
PGMIPPPG

SEQ ID NO: 4184 - protein, 8 aa, Homo sapiens
PMTQAPRI

SEQ ID NO: 4185 - protein, 8 aa, Homo sapiens
PPAQPLSE

SEQ ID NO: 4186 - protein, 8 aa, Homo sapiens
PPGAMPPQ

SEQ ID NO: 4187 - protein, 8 aa, Homo sapiens
PPGMIPPP

SEQ ID NO: 4188 - protein, 8 aa, Homo sapiens
PPMTQAPR

SEQ ID NO: 4189 - protein, 8 aa, Homo sapiens
PPPGLAPG

SEQ ID NO: 4190 - protein, 8 aa, Homo sapiens
PPQQLMPG

SEQ ID NO: 4191 - protein, 8 aa, Homo sapiens
PPYMPPPG

SEQ ID NO: 4192 - protein, 10 aa, Homo sapiens
PVGPAPGMRP

SEQ ID NO: 4193 - protein, 8 aa, Homo sapiens
PYMPPPGM

SEQ ID NO: 4194 - protein, 8 aa, Homo sapiens
QPPYMPPP

SEQ ID NO: 4195 - protein, 8 aa, Homo sapiens
RGVGGPSQ

SEQ ID NO: 4196 - protein, 8 aa, Homo sapiens
TPATKKAV

SEQ ID NO: 4197 - protein, 8 aa, Homo sapiens
YMPPPGMI

SEQ ID NO: 4198 - protein, 40 aa, Homo sapiens
RREFEVYGPIKRIHMVYSKRSGKPRGYAFIEYEHERDMHS

SEQ ID NO: 4199 - protein, 17 aa, Homo sapiens
KILGNQGSFLTKGPSKL

SEQ ID NO: 4200 - protein, 12 aa, Homo sapiens
TYICEVEDQKEE

SEQ ID NO: 4201 - protein, 18 aa, Homo sapiens
AEIETDKATIGFEVQEEG

SEQ ID NO: 4202 - protein, 15 aa, Homo sapiens
GLKKMLRTCAVHITL

SEQ ID NO: 4203 - protein, 18 aa, Homo sapiens
SAPATGGVKKPHRYRPGT

SEQ ID NO: 4204 - protein, 15 aa, Homo sapiens
AGAGRVRTSARAGST

SEQ ID NO: 4205 - protein, 15 aa, Homo sapiens
APAPRTRYPTRAPSG

SEQ ID NO: 4206 - protein, 15 aa, Homo sapiens
ATARRKRRWATRGPA

SEQ ID NO: 4207 - protein, 15 aa, Torque teno virus
AVLRAPQNPPPPGPQ

SEQ ID NO: 4208 - protein, 15 aa, Homo sapiens
CAGWALWRCALRWAE

SEQ ID NO: 4209 - protein, 15 aa, Torque teno virus
DEYKRFMNYWTASNE

SEQ ID NO: 4210 - protein, 15 aa, Human herpesvirus
DPVGHPAAPRAPGPE

SEQ ID NO: 4211 - protein, 15 aa, Torque teno virus
DRGEGNMLWIDWLSK

SEQ ID NO: 4212 - protein, 15 aa, Homo sapiens
DRRREGPDRSPRQPP

SEQ ID NO: 4213 - protein, 15 aa, Homo sapiens
GPDRSPRQPPVLPAA

SEQ ID NO: 4214 - protein, 15 aa, Homo sapiens
GPGAGDRRREGPDRS

SEQ ID NO: 4215 - protein, 15 aa, Homo sapiens
HPAFARAHGEAGAGR

SEQ ID NO: 4216 - protein, 15 aa, Homo sapiens
HRALARGPPARLGGE

SEQ ID NO: 4217 - protein, 15 aa, Homo sapiens
KRRWATRGPAHPAFA

SEQ ID NO: 4218 - protein, 15 aa, Homo sapiens
LRWAERQVGALGAES

SEQ ID NO: 4219 - protein, 15 aa, Homo sapiens
LWRCALRWAERQVGA

SEQ ID NO: 4220 - protein, 15 aa, Homo sapiens
PQDPRSPGPAPRHRR

SEQ ID NO: 4221 - protein, 15 aa, Homo sapiens
PRAPPARASYRRFRT

SEQ ID NO: 4222 - protein, 15 aa, Human herpesvirus
PRHGHSQGPWKPWSA

SEQ ID NO: 4223 - protein, 15 aa, Homo sapiens
PRHRHPQDPRSPGPA

SEQ ID NO: 4224 - protein, 15 aa, Homo sapiens
PRHRRPPRPDPRAPP

SEQ ID NO: 4225 - protein, 15 aa, Torque teno virus
PRSRHPGGPGTPQIR

SEQ ID NO: 4226 - protein, 15 aa, Human adenovirus
PSRRRRRRKATLAPA

SEQ ID NO: 4227 - protein, 15 aa, Homo sapiens
RAHGEAGAGRVRTSA

SEQ ID NO: 4228 - protein, 15 aa, Homo sapiens
RAPSGPRPPSRSQAQ

SEQ ID NO: 4229 - protein, 15 aa, Homo sapiens
RLGGEGPGAGDRRRE

SEQ ID NO: 4230 - protein, 15 aa, Homo sapiens
RLSPGHRALARGPPA

SEQ ID NO: 4231 - protein, 15 aa, Human herpesvirus
RVPRIPRDPRPPRPP

SEQ ID NO: 4232 - protein, 15 aa, Homo sapiens
SPGPAPRHRRPPRPD

SEQ ID NO: 4233 - protein, 15 aa, Homo sapiens
SWERRRLSPGHRALA

SEQ ID NO: 4234 - protein, 15 aa, Homo sapiens
TLRPAATARRKRRWA

SEQ ID NO: 4235 - protein, 15 aa, Homo sapiens
TPPRSVPRLRPRHRH

SEQ ID NO: 4236 - protein, 15 aa, Homo sapiens
TRGPAHPAFARAHGE

SEQ ID NO: 4237 - protein, 15 aa, Human herpesvirus
VASRPLFPPRSPGPS

SEQ ID NO: 4238 - protein, 15 aa, Homo sapiens
VPRLRPRHRHPQDPR

SEQ ID NO: 4239 - protein, 15 aa, Torque teno virus
WWARRRRRWRRWKRR

SEQ ID NO: 4240 - protein, 15 aa, Sus scrofa
AKKGEKVPKGKKGKA

SEQ ID NO: 4241 - protein, 15 aa, Sus scrofa
AKPAPPKPEPKPKKA

SEQ ID NO: 4242 - protein, 15 aa, Sus scrofa
ARLSAKPAPPKPEPK

SEQ ID NO: 4243 - protein, 15 aa, Sus scrofa
EKVPKGKKGKADAGK

SEQ ID NO: 4244 - protein, 15 aa, Sus scrofa
EPKPKKAPAKKGEKV

SEQ ID NO: 4245 - protein, 14 aa, Human herpesvirus
GRGRGRGRGRGGRG

SEQ ID NO: 4246 - protein, 14 aa, Homo sapiens
IKKVATPKKASPKK

SEQ ID NO: 4247 - protein, 15 aa, Sus scrofa
KDEPQRRSARLSAKP

SEQ ID NO: 4248 - protein, 15 aa, Homo sapiens
KSPKKAKAAKPKKAP

SEQ ID NO: 4249 - protein, 15 aa, Unknown
  epitope involved in systemic lupus
KTPKKAKKPKTPKKA

SEQ ID NO: 4250 - protein, 15 aa, Homo sapiens
PKKSAKKTPKKAKKP

SEQ ID NO: 4251 - protein, 15 aa, Sus scrofa
PKRKAEGDAKGDKAK

SEQ ID NO: 4252 - protein, 15 aa, Sus scrofa
PPKPEPKPKKAPAKK

SEQ ID NO: 4253 - protein, 16 aa, Homo sapiens
AAAGYDVEKNNSRIKL

SEQ ID NO: 4254 - protein, 15 aa, Homo sapiens
AAAPAEEKKVEAKKE

SEQ ID NO: 4255 - protein, 15 aa, Homo sapiens
AAAPVAAATTAAPAA

SEQ ID NO: 4256 - protein, 16 aa, Homo sapiens
AAKPKTAKPKAAKPKK

SEQ ID NO: 4257 - protein, 15 aa, Homo sapiens
AAPAKVEAKEESEES

SEQ ID NO: 4258 - protein, 15 aa, Homo sapiens
AEEKKVEAKKEESEE

SEQ ID NO: 4259 - protein, 8 aa, Homo sapiens
AFDKHMNL

SEQ ID NO: 4260 - protein, 16 aa, Homo sapiens
AGAAKRKASGPPVSEL

SEQ ID NO: 4261 - protein, 15 aa, Homo sapiens
AGGPAPAAGAAPAGG

SEQ ID NO: 4262 - protein, 16 aa, Homo sapiens
AKKAGAAKAKKPAGAA

SEQ ID NO: 4263 - protein, 8 aa, Homo sapiens
ALLRNLGK

SEQ ID NO: 4264 - protein, 8 aa, Homo sapiens
ALREYRKK

SEQ ID NO: 4265 - protein, 15 aa, Homo sapiens
APAAGAAPAGGPAPS

SEQ ID NO: 4266 - protein, 16 aa, Homo sapiens
APKSPAKAKAVKPKAA

SEQ ID NO: 4267 - protein, 15 aa, Homo sapiens
APSTAAAPAEEKKVE

SEQ ID NO: 4268 - protein, 16 aa, Homo sapiens
ATPKKSAKKTPKKAKK

SEQ ID NO: 4269 - protein, 8 aa, Homo sapiens
ATPPPGIM

SEQ ID NO: 4270 - protein, 8 aa, Homo sapiens
CDEFRKIK

SEQ ID NO: 4271 - protein, 15 aa, Homo sapiens
CNVGAGGPAPAAGAA

SEQ ID NO: 4272 - protein, 15 aa, Homo sapiens
DNVGSKQMQQIRMSL

SEQ ID NO: 4273 - protein, 15 aa, Homo sapiens
DRATWKSNYFLKIIQ

SEQ ID NO: 4274 - protein, 15 aa, Homo sapiens
DRLNKVISELNGKNI

SEQ ID NO: 4275 - protein, 15 aa, Homo sapiens
DVQLIKTGDKVGASE

SEQ ID NO: 4276 - protein, 15 aa, Homo sapiens
EADDDRLNKVISELN

SEQ ID NO: 4277 - protein, 15 aa, Homo sapiens
EDKINALIKAAGVNV

SEQ ID NO: 4278 - protein, 8 aa, Homo sapiens
EGPPPKDT

SEQ ID NO: 4279 - protein, 15 aa, Homo sapiens
EILSDVQLIKTGDKV

SEQ ID NO: 4280 - protein, 15 aa, Homo sapiens
EKKEESEESDDDMGF

SEQ ID NO: 4281 - protein, 16 aa, Homo sapiens
EKTPVKKKARKSAGAA

SEQ ID NO: 4282 - protein, 15 aa, Homo sapiens
EKTSFFQALGITTKI

SEQ ID NO: 4283 - protein, 15 aa, Homo sapiens
ELNGKNIEDVIAQGI

SEQ ID NO: 4284 - protein, 15 aa, Homo sapiens
ESEESDEDMGFGLFD

SEQ ID NO: 4285 - protein, 8 aa, Homo sapiens
EYRKKMDI

SEQ ID NO: 4286 - protein, 15 aa, Homo sapiens
FFQALGITTKISRGT

SEQ ID NO: 4287 - protein, 8 aa, Homo sapiens
FKAFDKHM

SEQ ID NO: 4288 - protein, 15 aa, Homo sapiens
GAVAVSAAPGSAAPA

SEQ ID NO: 4289 - protein, 15 aa, Homo sapiens
GGNSSPSAKDIKKIL

SEQ ID NO: 4290 - protein, 15 aa, Homo sapiens
GKAVVLMGKNTMMRK

SEQ ID NO: 4291 - protein, 15 aa, Homo sapiens
GLGPEKTSFFQALGI

SEQ ID NO: 4292 - protein, 8 aa, Homo sapiens
GLPPARGT

SEQ ID NO: 4293 - protein, 8 aa, Homo sapiens
GMPPPGMR

SEQ ID NO: 4294 - protein, 8 aa, Homo sapiens
GPPPPGMR

SEQ ID NO: 4295 - protein, 15 aa, Homo sapiens
GSLICNVGAGGPAPA

SEQ ID NO: 4296 - protein, 8 aa, Homo sapiens
GTFKAFDK

SEQ ID NO: 4297 - protein, 8 aa, Homo sapiens
IGLPPARG

SEQ ID NO: 4298 - protein, 16 aa, Homo sapiens
IKLGLKSLVSKGTLVQ

SEQ ID NO: 4299 - protein, 15 aa, Homo sapiens
IKTGDKVGASEATLL

SEQ ID NO: 4300 - protein, 15 aa, Homo sapiens
IQQVFDNGSIYNPEV

SEQ ID NO: 4301 - protein, 8 aa, Homo sapiens
IWAQKTNT

SEQ ID NO: 4302 - protein, 15 aa, Homo sapiens
KAAGVNVEPFWPGLF

SEQ ID NO: 4303 - protein, 8 aa, Homo sapiens
KAFDKHMN

SEQ ID NO: 4304 - protein, 16 aa, Homo sapiens
KAKKPAAAAGAKKAKS

SEQ ID NO: 4305 - protein, 15 aa, Homo sapiens
KEESEESDEDMGFGL

SEQ ID NO: 4306 - protein, 17 aa, Homo sapiens
KEIKKVATPKKASKPKK

SEQ ID NO: 4307 - protein, 15 aa, Homo sapiens
KKEESEESDDDMGFG

SEQ ID NO: 4308 - protein, 16 aa, Homo sapiens
KLNKKAASGEAKPKAK

SEQ ID NO: 4309 - protein, 15 aa, Homo sapiens
KNIEDVIAQGIGKLA

SEQ ID NO: 4310 - protein, 16 aa, Homo sapiens
KSPKKAKAAKPKKAPK

SEQ ID NO: 4311 - protein, 15 aa, Gallus gallus
KSRKASKAKKVKRSK

SEQ ID NO: 4312 - protein, 15 aa, Homo sapiens
KVEAKEESEESDEDM

SEQ ID NO: 4313 - protein, 15 aa, Homo sapiens
KVEAKKEESEESDDD

SEQ ID NO: 4314 - protein, 15 aa, Homo sapiens
LAALGGNSSPSAKDI

SEQ ID NO: 4315 - protein, 15 aa, Homo sapiens
LADPSAFVAAAPVAA

SEQ ID NO: 4316 - protein, 8 aa, Homo sapiens
LPPARGTP

SEQ ID NO: 4317 - protein, 11 aa, Homo sapiens
LQELEKDEREQ

SEQ ID NO: 4318 - protein, 8 aa, Homo sapiens
LREYRKKM

SEQ ID NO: 4319 - protein, 8 aa, Homo sapiens
MAPPPGMR

SEQ ID NO: 4320 - protein, 15 aa, Homo sapiens
MSLRGKAVVLMGKNT

SEQ ID NO: 4321 - protein, 15 aa, Homo sapiens
PAAAAAPAKVEAKEE

SEQ ID NO: 4322 - protein, 16 aa, Homo sapiens
PAGAAKKPKKATGAAT

SEQ ID NO: 4323 - protein, 15 aa, Homo sapiens
PALEKLLPHIRGNVG

SEQ ID NO: 4324 - protein, 8 aa, Homo sapiens
PGRGTPPP

SEQ ID NO: 4325 - protein, 8 aa, Homo sapiens
PPARGTPI

SEQ ID NO: 4326 - protein, 8 aa, Homo sapiens
PPGRGTPP

SEQ ID NO: 4327 - protein, 8 aa, Homo sapiens
PPPGIMAP

SEQ ID NO: 4328 - protein, 8 aa, Homo sapiens
PTQYPPGR

SEQ ID NO: 4329 - protein, 15 aa, Homo sapiens
QQIRMSLRGKAVVLM

SEQ ID NO: 4330 - protein, 8 aa, Homo sapiens
QVMTPQGR

SEQ ID NO: 4331 - protein, 8 aa, Homo sapiens
RATPPPGI

SEQ ID NO: 4332 - protein, 8 aa, Homo sapiens
REYRKKMD

SEQ ID NO: 4333 - protein, 8 aa, Homo sapiens
RGTPPPPV

SEQ ID NO: 4334 - protein, 8 aa, Homo sapiens
RKKMDIPA

SEQ ID NO: 4335 - protein, 8 aa, Homo sapiens
RPPPPGIR

SEQ ID NO: 4336 - protein, 16 aa, Homo sapiens
RSGVSLAALKKALAAA

SEQ ID NO: 4337 - protein, 6 aa, Gallus gallus
SHPTYS

SEQ ID NO: 4338 - protein, 6 aa, Gallus gallus
SHYKVG

SEQ ID NO: 4339 - protein, 16 aa, Gallus gallus
SKPRAKSGARKSPKKK

SEQ ID NO: 4340 - protein, 15 aa, Homo sapiens
SKQMQQIRMSLRGKA

SEQ ID NO: 4341 - protein, 15 aa, Homo sapiens
SPSAKDIKKILDSVG

SEQ ID NO: 4342 - protein, 6 aa, Gallus gallus
SSRQSI

SEQ ID NO: 4343 - protein, 31 aa, Gallus gallus; identical to SEQ ID NO: 3227

SEQ ID NO: 4344 - protein, 8 aa, Homo sapiens
TFKAFDKH

SEQ ID NO: 4345 - protein, 8 aa, Homo sapiens
TPPPGIMA

SEQ ID NO: 4346 - protein, 15 aa, Homo sapiens
TTAAPAAAAAPAKVE

SEQ ID NO: 4347 - protein, 15 aa, Homo sapiens
TVASVPHSIINGYKR

SEQ ID NO: 4348 - protein, 15 aa, Homo sapiens
VKAFLADPSAFVAAA

SEQ ID NO: 4349 - protein, 15 aa, Homo sapiens
VLMGKNTMMRKAIRG

SEQ ID NO: 4350 - protein, 15 aa, Homo sapiens
VNVEPFWPGLFAKAL

SEQ ID NO: 4351 - protein, 8 aa, Homo sapiens
VRGVGGPS

SEQ ID NO: 4352 - protein, 15 aa, Homo sapiens
VSAAPGSAAPAAGSA

SEQ ID NO: 4353 - protein, 16 aa, Homo sapiens
VSELITKAVAASKERS

SEQ ID NO: 4354 - protein, 15 aa, Homo sapiens
VTVTEDKINALIKAA

SEQ ID NO: 4355 - protein, 8 aa, Homo sapiens
YRKKMDIP

SEQ ID NO: 4356 - protein, 14 aa, Homo sapiens
FKEQFLDGDGWTSR

SEQ ID NO: 4357 - protein, 345 aa, Homo sapiens
MISPVLILFSSFLCHVAIAGRTCPKPDDLPFSTVVPLKTFYEPGEEITYSCKPGYVSRGGMRKFICPLTGLWPINTLKCTPRVCPFAGILENGAVRYTTFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECREVKCPFPSRPDNGFVNYPAKPTLYYKDKATFGCHDGYSLDGPEEIECTKLGNWSAMPSCKASCKLPVKKATVVYQGERVKIQEKFKNGMLHGDKVSFFCKNKEKKCSYTEDAQCIDGTIEVPKCFKEHSSLAFWKTDASDVKPC

SEQ ID NO: 4358 - protein, 7 aa, Homo sapiens
APSVTLF

SEQ ID NO: 4359 - protein, 7 aa, Homo sapiens
ATLVCLI

SEQ ID NO: 4360 - protein, 7 aa, Homo sapiens
AWHQQQP

SEQ ID NO: 4361 - protein, 7 aa, Homo sapiens
ERGLRYL

SEQ ID NO: 4362 - protein, 7 aa, Homo sapiens
ERILTIS

SEQ ID NO: 4363 - protein, 7 aa, Homo sapiens
GASVKVT

SEQ ID NO: 4364 - protein, 7 aa, Homo sapiens
GAVTVAW

SEQ ID NO: 4365 - protein, 7 aa, Homo sapiens
GSHTRGD

SEQ ID NO: 4366 - protein, 20 aa, Homo sapiens
IRGNRIRYFILPDSLPLDTI

SEQ ID NO: 4367 - protein, 7 aa, Homo sapiens
LMKINSD

SEQ ID NO: 4368 - protein, 19 aa, Homo sapiens
MKLVRFLMKLSHETVTIEL

SEQ ID NO: 4369 - protein, 7 aa, Homo sapiens
PDRFSGS

SEQ ID NO: 4370 - protein, 20 aa, Homo sapiens
PLDTIRVDVEPKVKSKKREA

SEQ ID NO: 4371 - protein, 7 aa, Homo sapiens
RGYDSYA

SEQ ID NO: 4372 - protein, 7 aa, Homo sapiens
SYLSLTP

SEQ ID NO: 4373 - protein, 7 aa, Homo sapiens
SYSCQVT

SEQ ID NO: 4374 - protein, 20 aa, Homo sapiens
TGVDVSMNTHLKAVKMTLKN

SEQ ID NO: 4375 - protein, 20 aa, Homo sapiens
VTIELKNGTQVHGTITGVDV

SEQ ID NO: 4376 - protein, 7 aa, Homo sapiens
WKAPSSP

SEQ ID NO: 4377 - protein, 7 aa, Homo sapiens
YAASSYL

SEQ ID NO: 4378 - protein, 7 aa, Homo sapiens
YCQTWGS

SEQ ID NO: 4379 - protein, 7 aa, Homo sapiens
YDSYAIA

SEQ ID NO: 4380 - protein, 8 aa, Homo sapiens
EVFISAPR

SEQ ID NO: 4381 - protein, 10 aa, Mus musculus
PAKSAPAPKK

SEQ ID NO: 4382 - protein, 30 aa, Mus musculus
PEPAKSAPAPKKGSKKAVTKAQKKDGKKRK

SEQ ID NO: 4383 - protein, 21 aa, Human T-lymphotropic virus
PPPPSSPTHDPPDSDPQIPPP

SEQ ID NO: 4384 - protein, 8 aa, Homo sapiens
PQIVPEPM

SEQ ID NO: 4385 - protein, 21 aa, Homo sapiens
PTRAPSGPRPPSRSQAQTPPR

SEQ ID NO: 4386 - protein, 10 aa, Homo sapiens
DGPPGELGPD

SEQ ID NO: 4387 - protein, 10 aa, Homo sapiens
DKERERRRSR

SEQ ID NO: 4388 - protein, 10 aa, Homo sapiens
EKIERRQQEV

SEQ ID NO: 4389 - protein, 10 aa, Homo sapiens
ENGYLMEAAP

SEQ ID NO: 4390 - protein, 10 aa, Homo sapiens
ERDKERERRR

SEQ ID NO: 4391 - protein, 10 aa, Homo sapiens
ERPGPSPLPH

SEQ ID NO: 4392 - protein, 10 aa, Homo sapiens
ERSRERDKER

SEQ ID NO: 4393 - protein, 10 aa, Homo sapiens
GERGSERGRD

SEQ ID NO: 4394 - protein, 10 aa, Homo sapiens
GGGLGGTRRG

SEQ ID NO: 4395 - protein, 10 aa, Homo sapiens
IERRQQEVET

SEQ ID NO: 4396 - protein, 10 aa, Homo sapiens
KEERRRSRER

SEQ ID NO: 4397 - protein, 8 aa, Homo sapiens
KMKGTFVE

SEQ ID NO: 4398 - protein, 10 aa, Homo sapiens
KRGERGSERG

SEQ ID NO: 4399 - protein, 10 aa, Homo sapiens
MERKRREKIE

SEQ ID NO: 4400 - protein, 10 aa, Homo sapiens
MMPVGPAPGM

SEQ ID NO: 4401 - protein, 10 aa, Homo sapiens
MTQFLPPNLL

SEQ ID NO: 4402 - protein, 10 aa, Homo sapiens
PGMMPVGPAP

SEQ ID NO: 4403 - protein, 10 aa, Homo sapiens
PGPSPLPHRD

SEQ ID NO: 4404 - protein, 10 aa, Homo sapiens
PPGELGPDGP

SEQ ID NO: 4405 - protein, 10 aa, Homo sapiens
PPPGMMPVGP

SEQ ID NO: 4406 - protein, 10 aa, Homo sapiens
PRRLGGGLGG

SEQ ID NO: 4407 - protein, 10 aa, Homo sapiens
PSPLPHRDRD

SEQ ID NO: 4408 - protein, 10 aa, Homo sapiens
REERMERKRR

SEQ ID NO: 4409 - protein, 10 aa, Homo sapiens
RERERRERSR

SEQ ID NO: 4410 - protein, 10 aa, Homo sapiens
RERRERSRER

SEQ ID NO: 4411 - protein, 10 aa, Homo sapiens
RKRREKIERR

SEQ ID NO: 4412 - protein, 10 aa, Homo sapiens
RLGGGLGGTR

SEQ ID NO: 4413 - protein, 10 aa, Homo sapiens
RREKIERRQQ

SEQ ID NO: 4414 - protein, 10 aa, Homo sapiens
RRERSRERDK

SEQ ID NO: 4415 - protein, 10 aa, Homo sapiens
SRERDKERER

SEQ ID NO: 4416 - protein, 10 aa, Homo sapiens
SRYDERPGPS

SEQ ID NO: 4417 - protein, 10 aa, Homo sapiens
YDERPGPSPL

SEQ ID NO: 4418 - protein, 21 aa, Mus musculus
STDHPKYSDMIVAAIQAEKNR

SEQ ID NO: 4419 - protein, 13 aa, Homo sapiens
AEVETDKATVGFE

SEQ ID NO: 4420 - protein, 21 aa, Homo sapiens
GPPPPGMMPVGPAPGMRPPMG

SEQ ID NO: 4421 - protein, 18 aa, Homo sapiens
VGPAPGMRPPMGGHMPMM

SEQ ID NO: 4422 - protein, 14 aa, Gallus gallus
DWMEEEEGAQREKE

SEQ ID NO: 4423 - protein, 8 aa, Homo sapiens
GTLHVVQR

SEQ ID NO: 4424 - protein, 8 aa, Homo sapiens
IIWRSTQG

SEQ ID NO: 4425 - protein, 8 aa, Homo sapiens
IWRSTQGV

SEQ ID NO: 4426 - protein, 8 aa, Homo sapiens
LGTLHVVQ

SEQ ID NO: 4427 - protein, 8 aa, Homo sapiens
RIIWRSTQ

SEQ ID NO: 4428 - protein, 8 aa, Homo sapiens
RVRVSWSP

SEQ ID NO: 4429 - protein, 8 aa, Homo sapiens
RVSWSPVP

SEQ ID NO: 4430 - protein, 21 aa, Gallus gallus
SASHPTYSEMIAAAIRAEKSR

SEQ ID NO: 4431 - protein, 14 aa, Gallus gallus
SQKEEEEGAQREKE

SEQ ID NO: 4432 - protein, 8 aa, Homo sapiens
TLHVVQRG

SEQ ID NO: 4433 - protein, 8 aa, Homo sapiens
VPRAQGFL

SEQ ID NO: 4434 - protein, 8 aa, Homo sapiens
VRVSWSPV

SEQ ID NO: 4435 - protein, 21 aa, Homo sapiens
ECLPQHAMFGNDTITCTTHGN

SEQ ID NO: 4436 - protein, 15 aa, Homo sapiens
KLPVKKATVVYQGER

SEQ ID NO: 4437 - protein, 16 aa, Homo sapiens
LPVKKATVVYQGERVK

SEQ ID NO: 4438 - protein, 14 aa, Homo sapiens
PVKKATVVYQGERV

SEQ ID NO: 4439 - protein, 17 aa, Unknown
  epitope involved in systemic lupus
APVCVWERLSPYRERCV

SEQ ID NO: 4440 - protein, 17 aa, Unknown
  epitope involved in systemic lupus
APVCVWERLSPYRERCV

SEQ ID NO: 4441 - protein, 21 aa, Unknown
  epitope involved in systemic lupus
APVCVWERLSPYRERCVPAEG

SEQ ID NO: 4442 - protein, 18 aa, Unknown
  epitope involved in systemic lupus
CHWDPFSLSAYFPGGGSC

SEQ ID NO: 4443 - protein, 12 aa, Unknown
  epitope involved in systemic lupus
HWDPFSLSAYFP

SEQ ID NO: 4444 - protein, 12 aa, Unknown
  epitope involved in systemic lupus
HWDPFSLSAYFP

SEQ ID NO: 4445 - protein, 16 aa, Unknown
  epitope involved in systemic lupus
HWDPFSLSAYFPGGGS

SEQ ID NO: 4446 - protein, 22 aa, Mus musculus
SGRGKGGKGLGKGGAKRHRKVL

SEQ ID NO: 4447 - protein, 22 aa, Mus musculus
SGRGKGGKGLGKGGAKRHRKVL

SEQ ID NO: 4448 - protein, 5 aa, Unknown
  epitope involved in systemic lupus
DWEYS

SEQ ID NO: 4449 - protein, 10 aa, Unknown
  epitope involved in systemic lupus
DWEYSVWSLN

SEQ ID NO: 4450 - protein, 18 aa, Mus musculus
LPDPYQKQCDDFVAEYEP

SEQ ID NO: 4451 - protein, 21 aa, Mus musculus
KEGYKVRLDLNITLEFRTTSK

SEQ ID NO: 4452 - protein, 15 aa, Homo sapiens
PPGMRPPMGPMGIPP

SEQ ID NO: 4453 - protein, 9 aa, Burkholderia fungorum
RAGTDEGFG

SEQ ID NO: 4454 - protein, 17 aa, Mus musculus
DGKWHTVKTEYIKRKAF

SEQ ID NO: 4455 - protein, 12 aa, Homo sapiens
GARGLTGRPGDA

SEQ ID NO: 4456 - protein, 12 aa, Homo sapiens
GARGLTGRPGDA

SEQ ID NO: 4457 - protein, 19 aa, Mus musculus
GRLHFMFDLGKGRTKVSHP

SEQ ID NO: 4458 - protein, 17 aa, Mus musculus
KATPMLKMRTSFHGCIK

SEQ ID NO: 4459 - protein, 21 aa, Mus musculus
KNLEISRSTFDLLRNSYGVRK

SEQ ID NO: 4460 - protein, 22 aa, Mus musculus
KQNCLSSRASFRGCVRNLRLSR

SEQ ID NO: 4461 - protein, 22 aa, Mus musculus
RPVRHAQCRVCDGNSTNPRERH

SEQ ID NO: 4462 - protein, 19 aa, Mus musculus
TSLRKALLHAPTGSYSDGQ

SEQ ID NO: 4463 - protein, 15 aa, Unknown
  epitope involved in systemic lupus
DHRSPPWLTSLLTIS

SEQ ID NO: 4464 - protein, 15 aa, Unknown
  epitope involved in systemic lupus
DTWPTARLTSSMQYI

SEQ ID NO: 4465 - protein, 15 aa, Unknown
  epitope involved in systemic lupus
GHRYTSSVSLTEACP

SEQ ID NO: 4466 - protein, 15 aa, Unknown
  epitope involved in systemic lupus
HTYTSHLRYVPPISL

SEQ ID NO: 4467 - protein, 15 aa, Unknown
  epitope involved in systemic lupus
KLTSSLRCNCPPLRF

SEQ ID NO: 4468 - protein, 15 aa, Unknown
  epitope involved in systemic lupus
KLTSSLRYNSPPLCF

SEQ ID NO: 4469 - protein, 15 aa, Unknown
  epitope involved in systemic lupus
KSTSSLRDNSPPVCF

SEQ ID NO: 4470 - protein, 15 aa, Unknown
  epitope involved in systemic lupus
QAPRLMSSLSYFPQS

SEQ ID NO: 4471 - protein, 15 aa, Unknown
  epitope involved in systemic lupus
RDGQRLTSSKTMLPY

SEQ ID NO: 4472 - protein, 10 aa, Unknown
  epitope involved in systemic lupus
RLTSSLRYNP

SEQ ID NO: 4473 - protein, 15 aa, Unknown
  epitope involved in systemic lupus
RRTPDPAVSPWQLTY

SEQ ID NO: 4474 - protein, 15 aa, Unknown
  epitope involved in systemic lupus
THDLSSRASSSLSYN

SEQ ID NO: 4475 - protein, 7 aa, Homo sapiens
ATVQLPQ

SEQ ID NO: 4476 - protein, 7 aa, Homo sapiens
QPHSRPY

SEQ ID NO: 4477 - protein, 15 aa, Homo sapiens
ASGFTFSNYAMHWVR

SEQ ID NO: 4478 - protein, 15 aa, Homo sapiens
GLEWVAVISYDGGNK

SEQ ID NO: 4479 - protein, 15 aa, Homo sapiens
KYYADSVKGRFTISR

SEQ ID NO: 4480 - protein, 14 aa, Homo sapiens
MHWVRQAPGKGLEW

SEQ ID NO: 4481 - protein, 14 aa, Homo sapiens
MYWVRQAPGKGLEW

SEQ ID NO: 4482 - protein, 15 aa, Homo sapiens
QAPGKGLEWVAVISY

SEQ ID NO: 4483 - protein, 15 aa, Homo sapiens
VAVISYDGGNKYYAD

SEQ ID NO: 4484 - protein, 13 aa, Homo sapiens
ALREYRKKMDIPA

SEQ ID NO: 4485 - protein, 29 aa, Homo sapiens
GGPPMMPMMGPPPPGMMPVGPAPGMRPPM

SEQ ID NO: 4486 - protein, 31 aa, Homo sapiens
HKENVKDYYQKWMEEQAQSLIDKTTAAFQQG

SEQ ID NO: 4487 - protein, 8 aa, Homo sapiens
APPDDGPP

SEQ ID NO: 4488 - protein, 8 aa, Homo sapiens
CETNTGEV

SEQ ID NO: 4489 - protein, 8 aa, Homo sapiens
EEEEDGEM

SEQ ID NO: 4490 - protein, 8 aa, Homo sapiens
EELQKREE

SEQ ID NO: 4491 - protein, 8 aa, Homo sapiens
EIHSKTKS

SEQ ID NO: 4492 - protein, 8 aa, Homo sapiens
NTEEYIDG

SEQ ID NO: 4493 - protein, 8 aa, Homo sapiens
PDGPDGPE

SEQ ID NO: 4494 - protein, 8 aa, Homo sapiens
WSKAHPPE

SEQ ID NO: 4495 - protein, 24 aa, Homo sapiens
FCPDVEFKRRFKEAFSKAAQQTKG

SEQ ID NO: 4496 - protein, 26 aa, Homo sapiens
FGHISGGHINPAVTVAMVCTRKISIA

SEQ ID NO: 4497 - protein, 22 aa, Homo sapiens
MSDRPTARRWGKCGPLCTRENI

SEQ ID NO: 4498 - protein, 6 aa, Homo sapiens
PPPGIR

SEQ ID NO: 4499 - protein, 6 aa, Homo sapiens
PPPGMR

SEQ ID NO: 4500 - protein, 4 aa, Homo sapiens
PQGR

SEQ ID NO: 4501 - protein, 18 aa, Homo sapiens
PESFDGDPASNTAPLQPE

SEQ ID NO: 4502 - protein, 17 aa, Homo sapiens
KIHAREIFDSRGNPTVE

SEQ ID NO: 4503 - protein, 8 aa, Homo sapiens
PDDLPFST

SEQ ID NO: 4504 - protein, 13 aa, Homo sapiens
GRPGRRGRPGLKG

SEQ ID NO: 4505 - protein, 13 aa, Homo sapiens
PGKVGPKGPMGPK

SEQ ID NO: 4506 - protein, 13 aa, Homo sapiens
YNQYSQRYHQRTN

SEQ ID NO: 4507 - protein, 15 aa, Homo sapiens
ADSASSSESERNITI

SEQ ID NO: 4508 - protein, 15 aa, Homo sapiens
AKATKDVERNLSRDL

SEQ ID NO: 4509 - protein, 15 aa, Homo sapiens
DDKKKKEAAQKKATE

SEQ ID NO: 4510 - protein, 15 aa, Homo sapiens
DGLRNSTGLGSQNKF

SEQ ID NO: 4511 - protein, 15 aa, Homo sapiens
DVERNLSRDLVQEEE

SEQ ID NO: 4512 - protein, 15 aa, Homo sapiens
HYENSQRGPVSSTSD

SEQ ID NO: 4513 - protein, 15 aa, Homo sapiens
KEAAQKKATEQKIKV

SEQ ID NO: 4514 - protein, 15 aa, Homo sapiens
KKATEQKIKVPEQIK

SEQ ID NO: 4515 - protein, 15 aa, Homo sapiens
KKKKKDDKKKKEAAQ

SEQ ID NO: 4516 - protein, 15 aa, Homo sapiens
KNAVVSDLSEKEAWP

SEQ ID NO: 4517 - protein, 15 aa, Homo sapiens
KQLLKRGQHFPVIAA

SEQ ID NO: 4518 - protein, 15 aa, Homo sapiens
KRATANNQQPQQQQQ

SEQ ID NO: 4519 - protein, 15 aa, Homo sapiens
LSRDLVQEEEQLMEE

SEQ ID NO: 4520 - protein, 15 aa, Homo sapiens
MRELEAKATKDVERN

SEQ ID NO: 4521 - protein, 15 aa, Homo sapiens
NLGSAVKVLNSQSES

SEQ ID NO: 4522 - protein, 15 aa, Homo sapiens
NNQQPQQQQQQQQPQ

SEQ ID NO: 4523 - protein, 15 aa, Homo sapiens
NSKNQSDINHSTSGS

SEQ ID NO: 4524 - protein, 15 aa, Homo sapiens
PQALPRYPREVPPRF

SEQ ID NO: 4525 - protein, 15 aa, Homo sapiens
PVIAANLGSAVKVLN

SEQ ID NO: 4526 - protein, 15 aa, Homo sapiens
QKIKVPEQIKPSVSQ

SEQ ID NO: 4527 - protein, 15 aa, Homo sapiens
QLMEEKKKKKDDKKK

SEQ ID NO: 4528 - protein, 15 aa, Homo sapiens
QPQQQPQALPRYPRE

SEQ ID NO: 4529 - protein, 15 aa, Homo sapiens
QPQQQQPQQQPQALP

SEQ ID NO: 4530 - protein, 15 aa, Homo sapiens
QQPQPQPQQQQPQQQ

SEQ ID NO: 4531 - protein, 15 aa, Homo sapiens
QQQPQQQPQPQPQQQ

SEQ ID NO: 4532 - protein, 15 aa, Homo sapiens
QQQPQQQQPQQQPQP

SEQ ID NO: 4533 - protein, 15 aa, Homo sapiens
QQQQQQQQPQQQQPQ

SEQ ID NO: 4534 - protein, 15 aa, Homo sapiens
QRGPVSSTSDSSTNC

SEQ ID NO: 4535 - protein, 15 aa, Homo sapiens
RHQEHKQLLKRGQHF

SEQ ID NO: 4536 - protein, 15 aa, Homo sapiens
RNITIMASGNTGGEK

SEQ ID NO: 4537 - protein, 15 aa, Homo sapiens
RYPREVPPRFRHQEH

SEQ ID NO: 4538 - protein, 15 aa, Homo sapiens
SALTNQQPQNNGEVQ

SEQ ID NO: 4539 - protein, 15 aa, Homo sapiens
SDINHSTSGSHYENS

SEQ ID NO: 4540 - protein, 15 aa, Homo sapiens
SNNGTSTATSTNNNA

SEQ ID NO: 4541 - protein, 15 aa, Homo sapiens
SSTSDSSTNCKNAVV

SEQ ID NO: 4542 - protein, 15 aa, Homo sapiens
STATSTNNNAKRATA

SEQ ID NO: 4543 - protein, 15 aa, Homo sapiens
STGLGSQNKFVVGSS

SEQ ID NO: 4544 - protein, 15 aa, Homo sapiens
TNNNAKRATANNQQP

SEQ ID NO: 4545 - protein, 15 aa, Homo sapiens
VKVLNSQSESSALTN

SEQ ID NO: 4546 - protein, 15 aa, Homo sapiens
VPPRFRHQEHKQLLK

SEQ ID NO: 4547 - protein, 15 aa, Homo sapiens
VQEEEQLMEEKKKKK

SEQ ID NO: 4548 - protein, 15 aa, Homo sapiens
KLTSEARGRIPVAQK

SEQ ID NO: 4549 - protein, 19 aa, Homo sapiens
ALMRGKSTEEARKELQAAG

SEQ ID NO: 4550 - protein, 19 aa, Homo sapiens
ASTNGLINFIKQQREARVQ

SEQ ID NO: 4551 - protein, 19 aa, Homo sapiens
EDLERLLPHKVFEGNRPTN

SEQ ID NO: 4552 - protein, 19 aa, Homo sapiens
FEFWDWVGGRYSLWSAIGL

SEQ ID NO: 4553 - protein, 19 aa, Homo sapiens
NYTEGRAVLHVALRNRSNT

SEQ ID NO: 4554 - protein, 19 aa, Homo sapiens
SFCQRVRSGDWKGYTGKTI

SEQ ID NO: 4555 - protein, 21 aa, Homo sapiens
YLASASTMDHARHGFLPRRHR

SEQ ID NO: 4556 - protein, 5 aa, Homo sapiens
PAPKK

SEQ ID NO: 4557 - protein, 5 aa, Homo sapiens
PAPKK

SEQ ID NO: 4558 - protein, 7 aa, Homo sapiens
PAPKKGS

SEQ ID NO: 4559 - protein, 8 aa, Homo sapiens
PAPKKGSK

SEQ ID NO: 4560 - protein, 9 aa, Homo sapiens
PAPKKGSKK

SEQ ID NO: 4561 - protein, 5 aa, Homo sapiens
PEPAK

SEQ ID NO: 4562 - protein, 21 aa, Homo sapiens
PEPAKSAPAPKKGSKKAVTKA

SEQ ID NO: 4563 - protein, 21 aa, Homo sapiens
PEPAKSAPAPKKGSKKAVTKA

SEQ ID NO: 4564 - protein, 21 aa, Homo sapiens
PEPAKSAPAPKKGSKKAVTKA

SEQ ID NO: 4565 - protein, 9 aa, Mus musculus
KTEKDPESE

SEQ ID NO: 4566 - protein, 12 aa, Bos taurus
AAGAVMRGFVFT

SEQ ID NO: 4567 - protein, 13 aa, Homo sapiens
IPSTVKAGELEKI

SEQ ID NO: 4568 - protein, 12 aa, Homo sapiens
ISRCQVCMKKRH

SEQ ID NO: 4569 - protein, 5 aa, Homo sapiens
MKKRH

SEQ ID NO: 4570 - protein, 11 aa, Homo sapiens
SLNPERMFRKP

SEQ ID NO: 4571 - protein, 36 aa, Homo sapiens
SLNPERMFRKPIPSTVKAGELEKIISRCQVCMKKRH

SEQ ID NO: 4572 - protein, 15 aa, Homo sapiens
TAIPSCPEGTVPLYS

SEQ ID NO: 4573 - protein, 9 aa, Homo sapiens
ISLWKGFSF

SEQ ID NO: 4574 - protein, 15 aa, Homo sapiens
TDIPPCPHGWISLWK

SEQ ID NO: 4575 - protein, 20 aa, Bos taurus
CNFASRNDYSYWLSTPEPMP

SEQ ID NO: 4576 - protein, 9 aa, Homo sapiens
GSPATWTTR

SEQ ID NO: 4577 - protein, 239 aa, Homo sapiens
RGDSGSPATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMFTSAGSEGTGQALASPGSCLEEFRASPFLECHGRGTCNYYSNSYSFWLASLNPERMFRKPIPSTVKAGELEKIISRCQVCMKKRH

SEQ ID NO: 4578 - protein, 15 aa, Bos taurus
CFEGQEKAHNQDLGL

SEQ ID NO: 4579 - protein, 15 aa, Bos taurus
CHGRGTCNYYANAYS

SEQ ID NO: 4580 - protein, 19 aa, Bos taurus
CNYYSNSYSFWLASLDPKR

SEQ ID NO: 4581 - protein, 13 aa, Bos taurus
CPAGWISLWKGFS

SEQ ID NO: 4582 - protein, 23 aa, Bos taurus
CTIERSEMFKPTPSTLKAGELRT

SEQ ID NO: 4583 - protein, 14 aa, Bos taurus
CYYASRNDKSYWLS

SEQ ID NO: 4584 - protein, 18 aa, Bos taurus
DVCNFASRNDYSYWLSTP

SEQ ID NO: 4585 - protein, 6 aa, Bos taurus
GLGFYG

SEQ ID NO: 4586 - protein, 18 aa, Homo sapiens
KFDVPCGGRDCSGGCQCY

SEQ ID NO: 4587 - protein, 14 aa, Bos taurus
LEPYISRCTVCEGP

SEQ ID NO: 4588 - protein, 13 aa, Bos taurus
PYALGKEERDRYR

SEQ ID NO: 4589 - protein, 20 aa, Homo sapiens
AIAVHSQTTDIPPCPHGWIS

SEQ ID NO: 4590 - protein, 20 aa, Homo sapiens
ALASPGSCLEEFRASPFLEC

SEQ ID NO: 4591 - protein, 20 aa, Homo sapiens
ALMPMNMAPITGRALEPYIS

SEQ ID NO: 4592 - protein, 20 aa, Homo sapiens
EFRASPFLECHGRGTCNYYS

SEQ ID NO: 4593 - protein, 20 aa, Homo sapiens
FTTMPFLFCNVNDVCNFASR

SEQ ID NO: 4594 - protein, 20 aa, Homo sapiens
HGRGTCNYYSNSYSFWLASL

SEQ ID NO: 4595 - protein, 20 aa, Homo sapiens
IPPCPHGWISLWKGFSFIMF

SEQ ID NO: 4596 - protein, 20 aa, Homo sapiens
IPSCPEGTVPLYSGFSFLFV

SEQ ID NO: 4597 - protein, 14 aa, Homo sapiens
KIISRCQVCMKKRH

SEQ ID NO: 4598 - protein, 20 aa, Homo sapiens
LGTLGSCLQRFTTMPFLFCN

SEQ ID NO: 4599 - protein, 20 aa, Homo sapiens
LWKGFSFIMFTSAGSEGTGQ

SEQ ID NO: 4600 - protein, 20 aa, Homo sapiens
LYSGFSFLFVQGNQRAHGQD

SEQ ID NO: 4601 - protein, 20 aa, Homo sapiens
NDYSYWLSIPALMPMNMAPI

SEQ ID NO: 4602 - protein, 20 aa, Homo sapiens
NSYSFWLASLNPERMFRKPI

SEQ ID NO: 4603 - protein, 20 aa, Homo sapiens
PSTVKAGELEKIISRCQVCM

SEQ ID NO: 4604 - protein, 20 aa, Homo sapiens
RCTVCEGPAIAIAVHSQTTD

SEQ ID NO: 4605 - protein, 20 aa, Homo sapiens
SPATWTTRGFVFTRHSQTTA

SEQ ID NO: 4606 - protein, 20 aa, Homo sapiens
TGRALEPYISRCTVCEGPAI

SEQ ID NO: 4607 - protein, 20 aa, Homo sapiens
TSAGSEGTGQALASPGSCLE

SEQ ID NO: 4608 - protein, 21 aa, Homo sapiens
VFTRHSQTTAIPSCPEGTVPL

SEQ ID NO: 4609 - protein, 21 aa, Homo sapiens
VNDVCNFASRNDYSYWLSTPA

SEQ ID NO: 4610 - protein, 44 aa, Homo sapiens
PGLKGKRGDSGSPATWTTRGFVFTRHSQTTAIPSCPEGTVPLYS

SEQ ID NO: 4611 - protein, 1670 aa, Homo sapiens
MSARTAPRPQVLLLPLLLVLLAAAPAASKGCVCKDKGQCFCDGAKGEKGEKGFPGPPGSPGQKGFTGPEGLPGPQGPKGFPGLPGLTGSKGVRGISGLPGFSGSPGLPGTPGNTGPYGLVGVPGCSGSKGEQGFPGLPGTPGYPGIPGAAGLKGQKGAPAKEEDIELDAKGDPGLPGAPGPQGLPGPPGFPGPVGPPGPPGFFGFPGAMGPRGPKGHMGERVIGHKGERGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEYGIKGQKGDIGPPGFRGPTEYYDTYQEKGDEGTPGPPGPRGARGPQGPSGPPGVPGSPGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTPGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGRPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMFTSAGSEGTGQALASPGSCLEEFRASPFLECHGRGTCNYYSNSYSFWLASLNPERMFRKPIPSTVKAGELEKIISRCQVCMKKRH

SEQ ID NO: 4612 - protein, 20 aa, Mus musculus
CPQDWVSLWKGFSFIMFTSA

SEQ ID NO: 4613 - protein, 11 aa, Mus musculus
DWVSLWKGFSF

SEQ ID NO: 4614 - protein, 16 aa, Mycobacterium tuberculosis
DLSLLGKARKVVVTKD

SEQ ID NO: 4615 - protein, 15 aa, Mycobacterium bovis
NPLGLKRGIEKAVEK

SEQ ID NO: 4616 - protein, 16 aa, Homo sapiens
QPHDLGKVGEVIVTKD

SEQ ID NO: 4617 - protein, 13 aa, Human herpesvirus
SYLKDSDFLDAAL

SEQ ID NO: 4618 - protein, 13 aa, Homo sapiens
SYLQDSDPDSFQD

SEQ ID NO: 4619 - protein, 14 aa, Homo sapiens
ALNEDLRSWTAADT

SEQ ID NO: 4620 - protein, 14 aa, Homo sapiens
ALNEDLSSWTAADT

SEQ ID NO: 4621 - protein, 15 aa, Homo sapiens
NPVEIRRGVMLAVDA

SEQ ID NO: 4622 - protein, 25 aa, Homo sapiens
QVSGPERTIPITREEKPAVTAAPKK

SEQ ID NO: 4623 - protein, 14 aa, Homo sapiens
DLYILMSHTSGSAA

SEQ ID NO: 4624 - protein, 14 aa, Homo sapiens
FLGELTSSEVATEV

SEQ ID NO: 4625 - protein, 14 aa, Homo sapiens
GVYLLTSHRTATAA

SEQ ID NO: 4626 - protein, 16 aa, Homo sapiens
KSMVILTSTVTAGTAE

SEQ ID NO: 4627 - protein, 12 aa, Bos taurus
NNRERRGIALDG

SEQ ID NO: 4628 - protein, 15 aa, Bos taurus
ADGSSWEGVGVVPDV

SEQ ID NO: 4629 - protein, 20 aa, Homo sapiens
GPTHLFQPSLVLDMAKVLLD

SEQ ID NO: 4630 - protein, 20 aa, Homo sapiens
SGIPYIISYLHPGNTILHVD

SEQ ID NO: 4631 - protein, 20 aa, Homo sapiens
ASSTIIKEGIDRTVLGILVS

SEQ ID NO: 4632 - protein, 13 aa, Homo sapiens
DTNLASSTIIKEG

SEQ ID NO: 4633 - protein, 20 aa, Homo sapiens
GFLGELTSSEVATEVPFRLM

SEQ ID NO: 4634 - protein, 16 aa, Bos taurus
LPLLANNRERRGIALD

SEQ ID NO: 4635 - protein, 14 aa, Bos taurus
NLYLTIPTARSVGA

SEQ ID NO: 4636 - protein, 20 aa, Homo sapiens
NRERRGIALDGKIKHEDTNL

SEQ ID NO: 4637 - protein, 12 aa, Homo sapiens
PTARSVGAADGS

SEQ ID NO: 4638 - protein, 23 aa, Bos taurus
PTARSVGAADGSSWEGVGVVPDV

SEQ ID NO: 4639 - protein, 14 aa, Bos taurus
VGAADGSSWEGVGV

SEQ ID NO: 4640 - protein, 20 aa, Homo sapiens
YQIKVKLTVSGFLGELTSSE

SEQ ID NO: 4641 - protein, 20 aa, Homo sapiens
LLANNRERRGIALDGKIKHE

SEQ ID NO: 4642 - protein, 16 aa, Homo sapiens
NRERRGIALDGKIKHE

SEQ ID NO: 4643 - protein, 25 aa, Homo sapiens
DKFVIFLDVKHFSPEDLTVKVQDDF

SEQ ID NO: 4644 - protein, 25 aa, Homo sapiens
GLDATHAERAIPVSREEKPTSAPSS

SEQ ID NO: 4645 - protein, 25 aa, Homo sapiens
GMLTFCGPKIQTGLDATHAERAIPV

SEQ ID NO: 4646 - protein, 25 aa, Homo sapiens
LSSDGVLTVNGPRKQVSGPERTIPI

SEQ ID NO: 4647 - protein, 25 aa, Homo sapiens
PEELKVKVLGDVIEVHGKHEERQDE

SEQ ID NO: 4648 - protein, 25 aa, Homo sapiens
RLEKDRFSVNLDVKHFSPEELKVKV

SEQ ID NO: 4649 - protein, 25 aa, Homo sapiens
TVKVQDDFVEIHGKHNERQDDHGYI

SEQ ID NO: 4650 - protein, 14 aa, Mus musculus
QTWEGSGVLPCVGT

SEQ ID NO: 4651 - protein, 20 aa, Mus musculus
SYSSAVPLLCSYFFEAEPRQ

SEQ ID NO: 4652 - protein, 20 aa, Unknown
  epitope involved in autoimmune uvetisis
ENSDSDYDREALQERLAKLA

SEQ ID NO: 4653 - protein, 20 aa, Mycobacterium leprae
ENSDSDYDREKLQERLAKLA

SEQ ID NO: 4654 - protein, 15 aa, Homo sapiens
LSSVVVDPSIRHFDV

SEQ ID NO: 4655 - protein, 15 aa, Homo sapiens
DVGEYRAVTELGRPD

SEQ ID NO: 4656 - protein, 15 aa, Homo sapiens
DVGVYRAVTPQGRPD

SEQ ID NO: 4657 - protein, 14 aa, Homo sapiens
GNRIAQWQSFQLEG

SEQ ID NO: 4658 - protein, 15 aa, Homo sapiens
KVKKIYLDEKRLLAG

SEQ ID NO: 4659 - protein, 31 aa, Homo sapiens; identical to SEQ ID NO: 923

SEQ ID NO: 4660 - protein, 11 aa, Homo sapiens
VLSPADKTNVK

SEQ ID NO: 4661 - protein, 31 aa, Homo sapiens; identical to SEQ ID NO: 928

SEQ ID NO: 4662 - protein, 14 aa, Homo sapiens
VVAGVANALAHKYH

SEQ ID NO: 4663 - protein, 19 aa, Homo sapiens
GLPRLETPADLSTAIASRS

SEQ ID NO: 4664 - protein, 11 aa, Homo sapiens
HARLRDSGRAY

SEQ ID NO: 4665 - protein, 20 aa, Homo sapiens
CNESSMQSLRQRKSVNALNS

SEQ ID NO: 4666 - protein, 20 aa, Homo sapiens
FQDTHNNAHYYVFFEEQEDE

SEQ ID NO: 4667 - protein, 19 aa, Homo sapiens
GIFNTGLKMFPDLTKVYST

SEQ ID NO: 4668 - protein, 16 aa, Homo sapiens
GPSLLDVSQTSVTALP

SEQ ID NO: 4669 - protein, 19 aa, Homo sapiens
IQRIPSLPPSTQTLKLIET

SEQ ID NO: 4670 - protein, 19 aa, Homo sapiens
ITDNPYMTSIPVNAFQGLC

SEQ ID NO: 4671 - protein, 20 aa, Homo sapiens
KNPQEETLQAFDSHYDYTIC

SEQ ID NO: 4672 - protein, 20 aa, Homo sapiens
LTRADLSYPSHCCAFKNQKK

SEQ ID NO: 4673 - protein, 19 aa, Homo sapiens
PDALKELPLLKFLGIFNTG

SEQ ID NO: 4674 - protein, 20 aa, Homo sapiens
PPARALKRSLWVEVDLLIGS

SEQ ID NO: 4675 - protein, 20 aa, Homo sapiens
PYEFSRKVPTFATPWPDFVP

SEQ ID NO: 4676 - protein, 19 aa, Homo sapiens
TKVYSTDIFFILEITDNPY

SEQ ID NO: 4677 - protein, 20 aa, Homo sapiens
VNALNSPLHQEYEENLGDSI

SEQ ID NO: 4678 - protein, 20 aa, Homo sapiens
ASRSVADKILDLYKHPDNID

SEQ ID NO: 4679 - protein, 12 aa, Homo sapiens
DPLIRGLLARPA

SEQ ID NO: 4680 - protein, 18 aa, Homo sapiens
EPTSGVIARAAEIMETSI

SEQ ID NO: 4681 - protein, 19 aa, Homo sapiens
FQQYVGPYEGYDSTANPTV

SEQ ID NO: 4682 - protein, 20 aa, Homo sapiens
HGLPGYNEWREFCGLPRLET

SEQ ID NO: 4683 - protein, 20 aa, Homo sapiens
HPDNIDVWLGGLAENFLPRA

SEQ ID NO: 4684 - protein, 18 aa, Homo sapiens
HWSADAVYQEARKVVGAL

SEQ ID NO: 4685 - protein, 20 aa, Homo sapiens
IPGMMLEAWRETFPQDDKCG

SEQ ID NO: 4686 - protein, 20 aa, Homo sapiens
KFPEDFESCDSIPGMMLEAW

SEQ ID NO: 4687 - protein, 19 aa, Homo sapiens
KVVGALHQIITLRDYIPRI

SEQ ID NO: 4688 - protein, 20 aa, Homo sapiens
LIGKQMKALRDGDWFWWENS

SEQ ID NO: 4689 - protein, 20 aa, Homo sapiens
LPRLETPADLSTAIASRSVA

SEQ ID NO: 4690 - protein, 20 aa, Homo sapiens
NFLPRARTGPLFACLIGKQM

SEQ ID NO: 4691 - protein, 18 aa, Homo sapiens
NRLAAALKALNAHWSADA

SEQ ID NO: 4692 - protein, 18 aa, Homo sapiens
RDYIPRILGPEAFQQYVG

SEQ ID NO: 4693 - protein, 13 aa, Homo sapiens
RGLLARPAKLQVQ

SEQ ID NO: 4694 - protein, 18 aa, Homo sapiens
TAAFRFGHATIHPLVRRL

SEQ ID NO: 4695 - protein, 933 aa, Homo sapiens
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 4696 - protein, 26 aa, Homo sapiens
DNTGLTRVPMDAFQVGKFPEDFESCD

SEQ ID NO: 4697 - protein, 20 aa, Homo sapiens
DSHYDYTICGDSEDMVCTPK

SEQ ID NO: 4698 - protein, 20 aa, Homo sapiens
FQGLCNETLTLKLYNNGFTS

SEQ ID NO: 4699 - protein, 33 aa, Homo sapiens
GYNEWREFCGLPRLETPADLSTAIASRSVADKI

SEQ ID NO: 4700 - protein, 45 aa, Homo sapiens
INLQRGRDHGLPGYNEWREFCGLPRLETPADLSTAIASRSVADKI

SEQ ID NO: 4701 - protein, 20 aa, Homo sapiens
IRGILESLMCNESSMQSLRQ

SEQ ID NO: 4702 - protein, 20 aa, Homo sapiens
KLPLSLSFLHLTRADLSYPS

SEQ ID NO: 4703 - protein, 20 aa, Homo sapiens
LDAVYLNKNKYLTVIDKDAF

SEQ ID NO: 4704 - protein, 20 aa, Homo sapiens
LHQEYEENLGDSIVGYKEKS

SEQ ID NO: 4705 - protein, 20 aa, Homo sapiens
NGFTSVQGYAFNGTKLDAVY

SEQ ID NO: 4706 - protein, 13 aa, Homo sapiens
QVGKFPEDFESCD

SEQ ID NO: 4707 - protein, 12 aa, Homo sapiens
STDDYASFSRAL

SEQ ID NO: 4708 - protein, 20 aa, Homo sapiens
YVSIDVTLQQLESHSFYNLS

SEQ ID NO: 4709 - protein, 20 aa, Homo sapiens
YYVFFEEQEDEIIGFGQELK

SEQ ID NO: 4710 - protein, 21 aa, Homo sapiens
DLYTHSEYYNHAIDWQTGPGC

SEQ ID NO: 4711 - protein, 19 aa, Mus musculus
NTTDMMIFDLIHNYNRFPD

SEQ ID NO: 4712 - protein, 16 aa, Homo sapiens
YAFNGTKLDAVYLNKN

SEQ ID NO: 4713 - protein, 11 aa, Homo sapiens
NKPLITVTNSK

SEQ ID NO: 4714 - protein, 9 aa, Rattus norvegicus
PPGEQTMGV

SEQ ID NO: 4715 - protein, 20 aa, Homo sapiens
VCTPKSDEFNPCEDIMGYKF

SEQ ID NO: 4716 - protein, 50 aa, Homo sapiens
ATKKEEEKKGGDRNTGLSRDKDKKREEMKEVAKKEDDEKVKGERRNTDTR

SEQ ID NO: 4717 - protein, 39 aa, Homo sapiens
LLKENTSLLKLGYHFELAGPRMTVTNLLSRNMDKQRQKR

SEQ ID NO: 4718 - protein, 37 aa, Homo sapiens
RGRDASKKALGPRRNSDLGKEPKRGGLKKSFSRDRDE

SEQ ID NO: 4719 - protein, 27 aa, Homo sapiens
ADLSTAIASRSVADKILDLYKHPDNID

SEQ ID NO: 4720 - protein, 20 aa, Homo sapiens
AFQVGKFPEDFESCDSIPGM

SEQ ID NO: 4721 - protein, 20 aa, Homo sapiens
AHPPCHASARCRNTKGGFQC

SEQ ID NO: 4722 - protein, 20 aa, Homo sapiens
ALKALNAHWSADAVYQEARK

SEQ ID NO: 4723 - protein, 20 aa, Homo sapiens
APEPGIPGETRGPCFLAGDG

SEQ ID NO: 4724 - protein, 20 aa, Homo sapiens
DPLIRGLLARPAKLQVQDQL

SEQ ID NO: 4725 - protein, 20 aa, Homo sapiens
EESGRRVLVYSCRHGYELQG

SEQ ID NO: 4726 - protein, 20 aa, Homo sapiens
EGWDFQPPLCKDVNECADGA

SEQ ID NO: 4727 - protein, 20 aa, Homo sapiens
ESRVSSVLEESKRLVDTAMY

SEQ ID NO: 4728 - protein, 20 aa, Homo sapiens
FSKLPEPTSGVIARAAEIME

SEQ ID NO: 4729 - protein, 21 aa, Homo sapiens
GGADCQMTCENQNPCFPIQLP

SEQ ID NO: 4730 - protein, 20 aa, Homo sapiens
GLWLHQAFFSPWTLLRGGGL

SEQ ID NO: 4731 - protein, 21 aa, Homo sapiens
GMNLEAWRETFPDQDDKCGFP

SEQ ID NO: 4732 - protein, 20 aa, Homo sapiens
GRLPRATWISMSLAALLIGG

SEQ ID NO: 4733 - protein, 20 aa, Homo sapiens
HSLSRVICDNTGLTRVPMDA

SEQ ID NO: 4734 - protein, 20 aa, Homo sapiens
HVIQVSNEVVTDDDRYSDLL

SEQ ID NO: 4735 - protein, 20 aa, Homo sapiens
KCPNTCLANKYRPITGACNN

SEQ ID NO: 4736 - protein, 20 aa, Homo sapiens
LPISETGGGTPELRCGKHQA

SEQ ID NO: 4737 - protein, 20 aa, Homo sapiens
METSIQAMKRKVNLKTQQSQ

SEQ ID NO: 4738 - protein, 20 aa, Homo sapiens
NEWREFCGLPRLETPADLST

SEQ ID NO: 4739 - protein, 22 aa, Homo sapiens
NEWREFCGLPRLETPADLSTAI

SEQ ID NO: 4740 - protein, 12 aa, Homo sapiens
NIFEYQVDAQPL

SEQ ID NO: 4741 - protein, 20 aa, Homo sapiens
PCFLAGDGRASEVPSLTALH

SEQ ID NO: 4742 - protein, 25 aa, Homo sapiens
PGYNEWREFCGLPRLETPADLSTAI

SEQ ID NO: 4743 - protein, 45 aa, Homo sapiens
PGYNEWREFCGLPRLETPADLSTAIASRSVADKILDLYKHPDNID

SEQ ID NO: 4744 - protein, 18 aa, Homo sapiens
QESAGMEGRDTHRLPRAL

SEQ ID NO: 4745 - protein, 20 aa, Homo sapiens
QQSQHPTDALSEDLLSIIAN

SEQ ID NO: 4746 - protein, 20 aa, Homo sapiens
QRNLKKRGILSPAQLLSFSK

SEQ ID NO: 4747 - protein, 20 aa, Homo sapiens
RPITGACNNRDHPRWGASNT

SEQ ID NO: 4748 - protein, 20 aa, Homo sapiens
TEAFFPFISRGKELLWGKPE

SEQ ID NO: 4749 - protein, 20 aa, Homo sapiens
VGPYEGYDSTANPTVSNVFS

SEQ ID NO: 4750 - protein, 20 aa, Homo sapiens
YEDGFSQPRGWNPGFLYNGF

SEQ ID NO: 4751 - protein, 20 aa, Homo sapiens
YELQGREQLTCTQEGWDFQP

SEQ ID NO: 4752 - protein, 15 aa, Homo sapiens
ALKALNAHWSADAVY

SEQ ID NO: 4753 - protein, 20 aa, Homo sapiens
AMKRKVNLKTQQSQHPTDAL

SEQ ID NO: 4754 - protein, 18 aa, Homo sapiens
GLPRLETPADLSTAIASR

SEQ ID NO: 4755 - protein, 13 aa, Homo sapiens
HPTDALSEDLLSI

SEQ ID NO: 4756 - protein, 13 aa, Homo sapiens
HVIQVSNEVVTDD

SEQ ID NO: 4757 - protein, 15 aa, Homo sapiens
IASRSVADKILDLYK

SEQ ID NO: 4758 - protein, 20 aa, Homo sapiens
LYKHPDNIDVWLGGLAENFL

SEQ ID NO: 4759 - protein, 15 aa, Homo sapiens
MTCENQNPCFPIQLP

SEQ ID NO: 4760 - protein, 18 aa, Homo sapiens
VGALHQIITLRDYIPRIL

SEQ ID NO: 4761 - protein, 10 aa, Homo sapiens
LVVYPWTQRF

SEQ ID NO: 4762 - protein, 15 aa, Homo sapiens
AAGLLSTYRAFLSSH

SEQ ID NO: 4763 - protein, 27 aa, Homo sapiens
AAHLPAEFTPAVHASLDKFLASVSTVL

SEQ ID NO: 4764 - protein, 32 aa, Homo sapiens
AAHLPAEFTPAVHASLDKFLASVSTVLTSKYR

SEQ ID NO: 4765 - protein, 21 aa, Homo sapiens
AAWGKVGAHAGEYGAEALERM

SEQ ID NO: 4766 - protein, 29 aa, Homo sapiens
AAWGKVGAHAGEYGAEALERMFLSFPTTK

SEQ ID NO: 4767 - protein, 19 aa, Homo sapiens
AFTPEGERLIGDAAKNQLT

SEQ ID NO: 4768 - protein, 14 aa, Homo sapiens
AGLLSTYRAFLSSH

SEQ ID NO: 4769 - protein, 15 aa, Homo sapiens
AGNLGGGVVTIERSK

SEQ ID NO: 4770 - protein, 15 aa, Homo sapiens
AHLLILRDTKTYMLA

SEQ ID NO: 4771 - protein, 16 aa, Homo sapiens
AHLLILRDTKTYMLAF

SEQ ID NO: 4772 - protein, 13 aa, Homo sapiens
AKAVKQFEESQGR

SEQ ID NO: 4773 - protein, 17 aa, Homo sapiens
AKAVKQFEESQGRTSSK

SEQ ID NO: 4774 - protein, 12 aa, Homo sapiens
AKFEELNMDLFR

SEQ ID NO: 4775 - protein, 18 aa, Homo sapiens
AKVAVLGASGGIGQPLSL

SEQ ID NO: 4776 - protein, 16 aa, Homo sapiens
ASGNYATVISHNPETK

SEQ ID NO: 4777 - protein, 12 aa, Homo sapiens
ASVSTVLTSKYR

SEQ ID NO: 4778 - protein, 16 aa, Homo sapiens
AVPSPPPASPRSQYNF

SEQ ID NO: 4779 - protein, 19 aa, Homo sapiens
AVPSPPPASPRSQYNFIAD

SEQ ID NO: 4780 - protein, 24 aa, Homo sapiens
AVTELGRPDAEYWNSQKDLLEQKR

SEQ ID NO: 4781 - protein, 17 aa, Homo sapiens
AYVRLAPDYDALDVANK

SEQ ID NO: 4782 - protein, 18 aa, Homo sapiens
DGRGALQNIIPASTGAAK

SEQ ID NO: 4783 - protein, 13 aa, Homo sapiens
DGVIKVFNDMKVR

SEQ ID NO: 4784 - protein, 15 aa, Homo sapiens
DIPELVNMGQWKIRA

SEQ ID NO: 4785 - protein, 16 aa, Homo sapiens
DKFLASVSTVLTSKYR

SEQ ID NO: 4786 - protein, 18 aa, Homo sapiens
DPSPSPVLGYKIVYKPVG

SEQ ID NO: 4787 - protein, 10 aa, Homo sapiens
DRVYIHPFHL

SEQ ID NO: 4788 - protein, 13 aa, Homo sapiens
DTNADKQLSFEEF

SEQ ID NO: 4789 - protein, 16 aa, Homo sapiens
DVPKWISIMTERSVPH

SEQ ID NO: 4790 - protein, 12 aa, Homo sapiens
EDFRDGLKLMLL

SEQ ID NO: 4791 - protein, 14 aa, Homo sapiens
EDIVADHVASYGVN

SEQ ID NO: 4792 - protein, 15 aa, Homo sapiens
EGLTFQMKKNAEELK

SEQ ID NO: 4793 - protein, 11 aa, Homo sapiens
EITALAPSTMK

SEQ ID NO: 4794 - protein, 15 aa, Homo sapiens
EQFYVDLDKKETVWH

SEQ ID NO: 4795 - protein, 14 aa, Homo sapiens
FDPIIEDRHGGYKP

SEQ ID NO: 4796 - protein, 15 aa, Homo sapiens
FDPIIEDRHGGYKPS

SEQ ID NO: 4797 - protein, 11 aa, Homo sapiens
FDSDVGEYRAV

SEQ ID NO: 4798 - protein, 18 aa, Homo sapiens
FESFGDLSTPDAVMGNPK

SEQ ID NO: 4799 - protein, 20 aa, Homo sapiens
FESFGDLSTPDAVMGNPKVK

SEQ ID NO: 4800 - protein, 14 aa, Homo sapiens
FLASVSTVLTSKYR

SEQ ID NO: 4801 - protein, 10 aa, Homo sapiens
FLENVIRDAV

SEQ ID NO: 4802 - protein, 24 aa, Homo sapiens
FLSFPTTKTYFPHFDLSHGSAQVK

SEQ ID NO: 4803 - protein, 28 aa, Homo sapiens
FLSFPTTKTYFPHFDLSHGSAQVKGHGK

SEQ ID NO: 4804 - protein, 29 aa, Homo sapiens
FLSFPTTKTYFPHFDLSHGSAQVKGHGKK

SEQ ID NO: 4805 - protein, 15 aa, Homo sapiens
GAPAAATAPAPTAHK

SEQ ID NO: 4806 - protein, 15 aa, Homo sapiens
GELEKEEAQPIVTKY

SEQ ID NO: 4807 - protein, 15 aa, Homo sapiens
GGELRFTVTQRSQPG

SEQ ID NO: 4808 - protein, 15 aa, Homo sapiens
GKEYFAIDNSGRIIT

SEQ ID NO: 4809 - protein, 12 aa, Homo sapiens
GLTFQMKKNAEE

SEQ ID NO: 4810 - protein, 14 aa, Homo sapiens
GLTFQMKKNAEELK

SEQ ID NO: 4811 - protein, 15 aa, Homo sapiens
GNRIAQWQSFQLEGG

SEQ ID NO: 4812 - protein, 18 aa, Homo sapiens
GRMHAPGKGLSQSALPYR

SEQ ID NO: 4813 - protein, 14 aa, Homo sapiens
GTLIIRDVKESDQG

SEQ ID NO: 4814 - protein, 17 aa, Homo sapiens
GTQGKIVDLVKELDRDT

SEQ ID NO: 4815 - protein, 12 aa, Homo sapiens
IGSSQDDGLINR

SEQ ID NO: 4816 - protein, 16 aa, Homo sapiens
IGSSYFPEHGYFRAPE

SEQ ID NO: 4817 - protein, 9 aa, Homo sapiens
IKEESKTAV

SEQ ID NO: 4818 - protein, 8 aa, Homo sapiens
IPDWFLNR

SEQ ID NO: 4819 - protein, 16 aa, Homo sapiens
IRASYAQQPAESRVSG

SEQ ID NO: 4820 - protein, 13 aa, Homo sapiens
ISWYDNEFGYSNR

SEQ ID NO: 4821 - protein, 18 aa, Homo sapiens
IVNTNVPRASVPDGFLSE

SEQ ID NO: 4822 - protein, 22 aa, Homo sapiens
IVNTNVPRASVPDGFLSELTQQ

SEQ ID NO: 4823 - protein, 18 aa, Homo sapiens
IYTRNTKGGDAPAAGEDA

SEQ ID NO: 4824 - protein, 13 aa, Homo sapiens
KAVLTIDEKGTEA

SEQ ID NO: 4825 - protein, 15 aa, Homo sapiens
KAVLTIDEKGTEAAG

SEQ ID NO: 4826 - protein, 14 aa, Homo sapiens
KEYFAIDNSGRIIT

SEQ ID NO: 4827 - protein, 15 aa, Homo sapiens
KFLASVSTVLTSKYR

SEQ ID NO: 4828 - protein, 15 aa, Homo sapiens
KPGQFIRSVDPDSPA

SEQ ID NO: 4829 - protein, 26 aa, Homo sapiens
KTNVKAAWGKVGAHAGEYGAEALERM

SEQ ID NO: 4830 - protein, 21 aa, Homo sapiens
LAQATGKPPQYIAVHVVPDQL

SEQ ID NO: 4831 - protein, 14 aa, Homo sapiens
LISWYDNEFGYSNR

SEQ ID NO: 4832 - protein, 12 aa, Homo sapiens
LITPAVVSERLK

SEQ ID NO: 4833 - protein, 13 aa, Homo sapiens
LKKYLYEIARRHP

SEQ ID NO: 4834 - protein, 19 aa, Homo sapiens
LLTEAPLNPKANREKMTQI

SEQ ID NO: 4835 - protein, 10 aa, Homo sapiens
LLVVYPWTQR

SEQ ID NO: 4836 - protein, 11 aa, Homo sapiens
LLVVYPWTQRF

SEQ ID NO: 4837 - protein, 9 aa, Homo sapiens
LRVDPVNFK

SEQ ID NO: 4838 - protein, 10 aa, Homo sapiens
LSLQEPGSKT

SEQ ID NO: 4839 - protein, 22 aa, Homo sapiens
LVTLAAHLPAEFTPAVHASLDK

SEQ ID NO: 4840 - protein, 16 aa, Homo sapiens
NIFSFYLSRDPDAQPG

SEQ ID NO: 4841 - protein, 21 aa, Homo sapiens
PMFIVNTNVPRASVPDGFLSE

SEQ ID NO: 4842 - protein, 15 aa, Homo sapiens
QLQPDNSTLTWVKPT

SEQ ID NO: 4843 - protein, 18 aa, Homo sapiens
QVDQFLGVPYAAPPLAER

SEQ ID NO: 4844 - protein, 18 aa, Homo sapiens
QVTQPTVGMNFKTPRGPV

SEQ ID NO: 4845 - protein, 13 aa, Homo sapiens
REIFNMARDQRSR

SEQ ID NO: 4846 - protein, 12 aa, Homo sapiens
RFDSDVGEFRAV

SEQ ID NO: 4847 - protein, 14 aa, Homo sapiens
RGNSIIMLEALERV

SEQ ID NO: 4848 - protein, 13 aa, Homo sapiens
RLLLPGELAKHAV

SEQ ID NO: 4849 - protein, 18 aa, Homo sapiens
RLLLPGELAKHAVSEGTK

SEQ ID NO: 4850 - protein, 16 aa, Homo sapiens
RLPIIDVAPLDVGAPD

SEQ ID NO: 4851 - protein, 16 aa, Homo sapiens
RPKDYEVDATLKSLNN

SEQ ID NO: 4852 - protein, 16 aa, Homo sapiens
RVMTIAPGLFGTPLLT

SEQ ID NO: 4853 - protein, 13 aa, Homo sapiens
RYSVDIPLDKTVV

SEQ ID NO: 4854 - protein, 21 aa, Homo sapiens
SETAPAAPAAAPPAEKAPVKK

SEQ ID NO: 4855 - protein, 22 aa, Homo sapiens
SETAPAAPAAAPPAEKAPVKKK

SEQ ID NO: 4856 - protein, 33 aa, Homo sapiens
SGNFGGSRNMGGPYGGGNYGPGGSGGSGGYGGR

SEQ ID NO: 4857 - protein, 14 aa, Homo sapiens
SRAGLELGAEPETI

SEQ ID NO: 4858 - protein, 11 aa, Homo sapiens
SRTSGLLSSWK

SEQ ID NO: 4859 - protein, 14 aa, Homo sapiens
SVPRYLPRPANPDE

SEQ ID NO: 4860 - protein, 16 aa, Homo sapiens
SWNSGALTSGVHTFPA

SEQ ID NO: 4861 - protein, 14 aa, Homo sapiens
SWYDNEFGYSNRVV

SEQ ID NO: 4862 - protein, 18 aa, Homo sapiens
SYELPDGQVITIGNERFR

SEQ ID NO: 4863 - protein, 16 aa, Homo sapiens
TGAAPIIDVVRSGYYK

SEQ ID NO: 4864 - protein, 23 aa, Homo sapiens
TGGASGLGLATAERLVGQGASAV

SEQ ID NO: 4865 - protein, 13 aa, Homo sapiens
TGKNKWFFQKLRF

SEQ ID NO: 4866 - protein, 15 aa, Homo sapiens
TNVPPEVTVLTNSPV

SEQ ID NO: 4867 - protein, 14 aa, Homo sapiens
TQGKIVDLVKELDR

SEQ ID NO: 4868 - protein, 16 aa, Homo sapiens
TQGKIVDLVKELDRDT

SEQ ID NO: 4869 - protein, 11 aa, Homo sapiens
TVDGPSGKLWR

SEQ ID NO: 4870 - protein, 17 aa, Homo sapiens
TWLRNGKPVTTGVSETV

SEQ ID NO: 4871 - protein, 16 aa, Homo sapiens
TYFPHFDLSHGSAQVK

SEQ ID NO: 4872 - protein, 21 aa, Homo sapiens
TYFPHFDLSHGSAQVKGHGKK

SEQ ID NO: 4873 - protein, 29 aa, Homo sapiens
VADALTNAVAHVDDMPNALSALSDLHAHK

SEQ ID NO: 4874 - protein, 15 aa, Homo sapiens
VGAHAGEYGAEALER

SEQ ID NO: 4875 - protein, 24 aa, Homo sapiens
VGAHAGEYGAEALERMFLSFPTTK

SEQ ID NO: 4876 - protein, 17 aa, Homo sapiens
VHKAVLTIDEKGTEAAG

SEQ ID NO: 4877 - protein, 8 aa, Homo sapiens
VHLTPEEK

SEQ ID NO: 4878 - protein, 32 aa, Homo sapiens
VHLTPEEKSAVTALWGKVNVDEVGGEALGRLL

SEQ ID NO: 4879 - protein, 16 aa, Homo sapiens
VLSPADKTNVKAAWGK

SEQ ID NO: 4880 - protein, 32 aa, Homo sapiens
VLSPADKTNVKAAWGKVGAHAGEYGAEALERM

SEQ ID NO: 4881 - protein, 33 aa, Homo sapiens
VLSPADKTNVKAAWGKVGAHAGEYGAEALERMF

SEQ ID NO: 4882 - protein, 12 aa, Homo sapiens
VVDLMAHMASKE

SEQ ID NO: 4883 - protein, 11 aa, Homo sapiens
VWRLEEFGRFA

SEQ ID NO: 4884 - protein, 16 aa, Homo sapiens
WLRNGKPVTTGVSETV

SEQ ID NO: 4885 - protein, 10 aa, Homo sapiens
WRLEEFGRFA

SEQ ID NO: 4886 - protein, 14 aa, Homo sapiens
YDHNFVKAINAIQK

SEQ ID NO: 4887 - protein, 16 aa, Homo sapiens
YGGELRFTVTQRSQPG

SEQ ID NO: 4888 - protein, 16 aa, Homo sapiens
YPKSLHMYANRLLDHR

SEQ ID NO: 4889 - protein, 12 aa, Homo sapiens
YYKVDENGKISR

SEQ ID NO: 4890 - protein, 23 aa, Homo sapiens
AVTELGRPDAEYWNSQKDILEQK

SEQ ID NO: 4891 - protein, 18 aa, Homo sapiens
CPTPCQLQAEQAFLRTVQ

SEQ ID NO: 4892 - protein, 17 aa, Homo sapiens
FIVNTNVPRASVPDGFL

SEQ ID NO: 4893 - protein, 11 aa, Homo sapiens
LLIPTSFSPLK

SEQ ID NO: 4894 - protein, 20 aa, Homo sapiens
PAAPAAPAPAEKTPVKKKAR

SEQ ID NO: 4895 - protein, 764 aa, Homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSVYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKDTKIAKRMAVLIFTDFICMAPISFYALSAILNKPLITVSNSKILLVLFYPLNSCANPFLYAIFTKAFQRDVFILLSKFGICKRQAQAYRGQRVPPKNSTDIQVQKVTHDMRQGLHNMEDVYELIENSHLTPKKQGQISEEYMQTVL

SEQ ID NO: 4896 - protein, 9 aa, Homo sapiens
ALAVLSVTL

SEQ ID NO: 4897 - protein, 9 aa, Homo sapiens
ALSEDLLSI

SEQ ID NO: 4898 - protein, 9 aa, Homo sapiens
GLLDQVAAL

SEQ ID NO: 4899 - protein, 9 aa, Homo sapiens
GLREDLLSL

SEQ ID NO: 4900 - protein, 9 aa, Homo sapiens
LLIGGFAGL

SEQ ID NO: 4901 - protein, 10 aa, Homo sapiens
SLQDVPLAAL

SEQ ID NO: 4902 - protein, 9 aa, Streptococcus pyogenes
ALEKLNKEL

SEQ ID NO: 4903 - protein, 9 aa, Homo sapiens
EFQKMRRDL

SEQ ID NO: 4904 - protein, 9 aa, Streptococcus pyogenes
KLNKELEES

SEQ ID NO: 4905 - protein, 9 aa, Homo sapiens
KMRRDLEEA

SEQ ID NO: 4906 - protein, 43 aa, Homo sapiens
AERAALEELVKLQGERVRGLKQQKASAELIEEEVAKLLKLKAQ

SEQ ID NO: 4907 - protein, 25 aa, Homo sapiens
VAGRGRGRGRGRGRGRGRGRGGPRR

SEQ ID NO: 4908 - protein, 10 aa, Homo sapiens
GSASPMELLS

SEQ ID NO: 4909 - protein, 10 aa, Homo sapiens
IFMSNSYPRD

SEQ ID NO: 4910 - protein, 12 aa, Homo sapiens
RLDNRYQPMEPN

SEQ ID NO: 4911 - protein, 10 aa, Homo sapiens
SARIPCFLAG

SEQ ID NO: 4912 - protein, 10 aa, Homo sapiens
WDGERLYQEA

SEQ ID NO: 4913 - protein, 10 aa, Homo sapiens
WTPGVKRNGF

SEQ ID NO: 4914 - protein, 10 aa, Homo sapiens
YRSYNDSVDP

SEQ ID NO: 4915 - protein, 7 aa, Helicobacter pylori
AKEERRY

SEQ ID NO: 4916 - protein, 7 aa, Unknown
  epitope involved in autoimmune pancreatitis
RFEQPRV

SEQ ID NO: 4917 - protein, 7 aa, Unknown
  epitope involved in autoimmune pancreatitis
SKDERRF

SEQ ID NO: 4918 - protein, 15 aa, Mycobacterium avium
TCRRMLAFLKDKENR

SEQ ID NO: 4919 - protein, 15 aa, Homo sapiens
GEALSTLVLNRLKVG

SEQ ID NO: 4920 - protein, 15 aa, Mycobacterium sp.
GEALSTLVVNKIRGT

SEQ ID NO: 4921 - protein, 15 aa, Mycobacterium sp.
IAGLFLTTEAVVADK

SEQ ID NO: 4922 - protein, 15 aa, Homo sapiens
VASLLTTAEVVVTEI

SEQ ID NO: 4923 - protein, 9 aa, Unknown
  epitope involved in Crohn's disease
GGIYQDLVS

SEQ ID NO: 4924 - protein, 9 aa, Unknown
  epitope involved in Crohn's disease
GLLAQQMDY

SEQ ID NO: 4925 - protein, 9 aa, Unknown
  epitope involved in Crohn's disease
RLVGQQVMQ

SEQ ID NO: 4926 - protein, 9 aa, Unknown
  epitope involved in Crohn's disease
RQSDGQYQM

SEQ ID NO: 4927 - protein, 9 aa, Unknown
  epitope involved in Crohn's disease
YRWLPPSSA

SEQ ID NO: 4928 - protein, 15 aa, Mycobacterium avium
AGDLSKVDAKQPGDY

SEQ ID NO: 4929 - protein, 15 aa, Homo sapiens
CQALVRMLAKKPGWK

SEQ ID NO: 4930 - protein, 15 aa, Homo sapiens
DFTYDQVAFNGLPQF

SEQ ID NO: 4931 - protein, 15 aa, Homo sapiens
DKIRGEGMRYIIILD

SEQ ID NO: 4932 - protein, 15 aa, Mycobacterium avium
ERPLKQIAFNGGLEP

SEQ ID NO: 4933 - protein, 15 aa, Homo sapiens
GRGNGDPGGGMEKDG

SEQ ID NO: 4934 - protein, 15 aa, Mycobacterium avium
LAKLAGGVAVICAGA

SEQ ID NO: 4935 - protein, 15 aa, Homo sapiens
LAKLGGAGQAARAGT

SEQ ID NO: 4936 - protein, 14 aa, Homo sapiens
NEHPVFAYLKDKLP

SEQ ID NO: 4937 - protein, 15 aa, Mycobacterium avium
QLELTEGMRFDKGYI

SEQ ID NO: 4938 - protein, 11 aa, Unknown
  epitope involved in Crohn's disease
CNLWEVMHGTC

SEQ ID NO: 4939 - protein, 11 aa, Unknown
  epitope involved in Crohn's disease
CSIGEALSHGC

SEQ ID NO: 4940 - protein, 9 aa, Unknown
  epitope involved in Crohn's disease
PWATLVAES

SEQ ID NO: 4941 - protein, 9 aa, Unknown
  epitope involved in Crohn's disease
TMWDALEAP

SEQ ID NO: 4942 - protein, 15 aa, Mycobacterium avium
TCRRMLAFLKDKENR

SEQ ID NO: 4943 - protein, 5 aa, Homo sapiens
PKKAK

SEQ ID NO: 4944 - protein, 15 aa, Mycobacterium avium
AGDLSKVDAKQPGDY

SEQ ID NO: 4945 - protein, 15 aa, Homo sapiens
CQALVRMLAKKPGWK

SEQ ID NO: 4946 - protein, 15 aa, Homo sapiens
DFTYDQVAFNGLPQF

SEQ ID NO: 4947 - protein, 15 aa, Homo sapiens
DKIRGEGMRYIIILD

SEQ ID NO: 4948 - protein, 15 aa, Mycobacterium avium
ERPLKQIAFNGGLEP

SEQ ID NO: 4949 - protein, 15 aa, Homo sapiens
GRGNGDPGGGMEKDG

SEQ ID NO: 4950 - protein, 14 aa, Homo sapiens
NEHPVFAYLKDKLP

SEQ ID NO: 4951 - protein, 15 aa, Mycobacterium avium
QLELTEGMRFDKGYI

SEQ ID NO: 4952 - protein, 9 aa, Homo sapiens
AHWSGHCCL

SEQ ID NO: 4953 - protein, 15 aa, Mycobacterium avium
TCRRMLAFLKDKENR

SEQ ID NO: 4954 - protein, 5 aa, Homo sapiens
PKKAK

SEQ ID NO: 4955 - protein, 15 aa, Mycobacterium avium
AGDLSKVDAKQPGDY

SEQ ID NO: 4956 - protein, 15 aa, Homo sapiens
CQALVRMLAKKPGWK

SEQ ID NO: 4957 - protein, 15 aa, Homo sapiens
DFTYDQVAFNGLPQF

SEQ ID NO: 4958 - protein, 15 aa, Homo sapiens
DKIRGEGMRYIIILD

SEQ ID NO: 4959 - protein, 15 aa, Mycobacterium avium
ERPLKQIAFNGGLEP

SEQ ID NO: 4960 - protein, 15 aa, Homo sapiens
GRGNGDPGGGMEKDG

SEQ ID NO: 4961 - protein, 14 aa, Homo sapiens
NEHPVFAYLKDKLP

SEQ ID NO: 4962 - protein, 15 aa, Mycobacterium avium
QLELTEGMRFDKGYI

SEQ ID NO: 4963 - protein, 9 aa, Homo sapiens
AHWSGHCCL

SEQ ID NO: 4964 - protein, 15 aa, Mycobacterium avium
TCRRMLAFLKDKENR

SEQ ID NO: 4965 - protein, 5 aa, Homo sapiens
PKKAK

SEQ ID NO: 4966 - protein, 15 aa, Mycobacterium avium
AGDLSKVDAKQPGDY

SEQ ID NO: 4967 - protein, 15 aa, Homo sapiens
CQALVRMLAKKPGWK

SEQ ID NO: 4968 - protein, 15 aa, Homo sapiens
DFTYDQVAFNGLPQF

SEQ ID NO: 4969 - protein, 15 aa, Homo sapiens
DKIRGEGMRYIIILD

SEQ ID NO: 4970 - protein, 15 aa, Mycobacterium avium
ERPLKQIAFNGGLEP

SEQ ID NO: 4971 - protein, 15 aa, Homo sapiens
GRGNGDPGGGMEKDG

SEQ ID NO: 4972 - protein, 14 aa, Homo sapiens
NEHPVFAYLKDKLP

SEQ ID NO: 4973 - protein, 15 aa, Mycobacterium avium
QLELTEGMRFDKGYI

SEQ ID NO: 4974 - protein, 9 aa, Homo sapiens
AHWSGHCCL

SEQ ID NO: 4975 - protein, 304 aa, Homo sapiens
MGNHAGKRELNAEKASTNSETNRGESEKKRNLGELSRTTSEDNEVFGEADANQNNGTSSQDTAVTDSKRTADPKNAWQDAHPADPGSRPHLIRLFSRDAPGREDNTFKDRPSESDELQTIQEDSAATSESLDVMASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKLGGRDSRSGSPMARR

SEQ ID NO: 4976 - protein, 203 aa, Homo sapiens [sequence omitted]

SEQ ID NO: 4977 - protein, 277 aa, Homo sapiens
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKGRGSRGQHQAHSLERVCHCLGKWLGHPDKFVGITYALTVVWLLVFACSAVPVYIYFNTWTTCQSIAFPSKTSASIGSLCADARMYGVLPWNAFPGKVCGSNLLSICKTAEFQMTFHLFIAAFVGAAATLVSLLTFMIAATYNFAVLKLMGRGTKF

SEQ ID NO: 4978 - protein, 295 aa, Homo sapiens [sequence omitted]

SEQ ID NO: 4979 - protein, 323 aa, Homo sapiens
MSDRPTARRWGKCGPLCTRENIMVAFKGVWTQAFWKAVTAEFLAMLIFVLLSLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAINYTGASMNPARSFGPAVIMGNWENHWIYWVGPIIGAVLAGGLYEYVFCPDVEFKRRFKEAFSKAAQQTKGSYMEVEDNRSQVETDDLILKPGVVHVIDVDRGEEKKGKDQSGEVLSSV

SEQ ID NO: 4980 - protein, 582 aa, Homo sapiens
MIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESKEVSTLESH

SEQ ID NO: 4981 - protein, 110 aa, Homo sapiens
MALWMRLLPLLALLALWGPDPAAAFVNQHLCGSHLVEALYLVCGERGFFYTPKTRREAEDLQVGQVELGGGPGAGSLQPLALEGSLQKRGIVEQCCTSICSLYQLENYCN

SEQ ID NO: 4982 - protein, 180 aa, Homo sapiens
IAPVFVLMEQITLKKMRKIVGWSNKDGDGIFSPGGAISNMYSIMAARYKYFPEVKTKGMAAVPKLVLFTSEHSHYSIKKAGAALGFGTDNVILIKCNERGKIIPADLEAKILDAKQKGYVPLYVNATAGTTVYGAFDPIQEIADICEKYNLWLHVDAAWGGGLLMSRKHRHKLSGIERAN

SEQ ID NO: 4983 - protein, 296 aa, Triticum urartu
MKTFLILALLAIVATTATTAVRVPVPQPQPQNPSQPQPQRQVPLVQQQQFPGQQQQFPPQQPYPQPQPFPSQQPYLQLQPFPQPQPFPPQLPYPQPPPFSPQQPYPQPQPQYPQPQQPISQQQAQQQQQQQQQQQQQQQQQQILPQILQQQLIPCRDVVLQQHNIAHARSQVLQQSTYQPLQQLCCQQLWQIPEQSRCQAIHNVVHAIILHQQQQQQQPSSQVSLQQPQQQYPSGQGFFQPSQQNPQAQGSVQPQQLPQFEEIRNLALQTLPRMCNVYIPPYCSTTTAPFGIFGTN

SEQ ID NO: 4984 - protein, 275 aa, Triticum durum
MNIQVDPSSQVQWPQQQPFLQPHQPFSQQPQQIFPQPQQTFPHQPQQQFPQPQQPQRQFLQPRQPFPQQPQQPYPQQPQQPFPQTQQPQQPFPQSKQPQQPFPQPQQPQQSFPQQQPSLIQQSLQQQLNPCKNFLLQQCKPVSLVSSLWSIILPPSDCQVMRQQCCQQLAQIPQQLQCAAIHSVVHSIIMQQEQQEQLQGVQILVPLSQQQQVGQGILVQGQGIIQPQQPAQLEVIRSLVLQTLPTMCNVYVPPYCSTIRAPFASIVAGIGGQYR

SEQ ID NO: 4985 - protein, 282 aa, Triticum aestivum
MNIQVDPSSQVPWPQQQPFPQPHQPFSQQPQQTFPQPQQTFPHQPQQQFSQPQQPQQQFIQPQQPFPQQPQQTYPQRPQQPFPQTQQPQQPFPQSQQPQQPFPQPQQQFPQPQQPQQSFPQQQPSLIQQSLQQQLNPCKNFLLQQCKPVSLVSSLWSMILPRSDCQVMRQQCCQQLAQIPQQLQCAAIHSIVHSIIMQQEQQEQRQGVQILVPLSQQQQVGQGTLVQGQGIIQPQQPAQLEVIRSLVLQTLATMCNVYVPPYCSTIRAPFASIVAGIGGQYR

SEQ ID NO: 4986 - protein, 9 aa, Triticum sp.
PFPQPELPY

SEQ ID NO: 4987 - protein, 9 aa, Triticum sp.
PYPQPELPY

SEQ ID NO: 4988 - protein, 9 aa, Triticum sp.
PQPELPYPW

SEQ ID NO: 4989 - protein, 10 aa, Triticum sp.
FRPPEQPYPQ

SEQ ID NO: 4990 - protein, 9 aa, Triticum sp.
PQQSFPEQQ

SEQ ID NO: 4991 - protein, 9 aa, Triticum sp.
IQPEQPAQL

SEQ ID NO: 4992 - protein, 9 aa, Triticum sp.
QQPEQPYPQ

SEQ ID NO: 4993 - protein, 9 aa, Triticum sp.
SQPEQEFPQ

SEQ ID NO: 4994 - protein, 9 aa, Triticum sp.
PQPEQEFPQ

SEQ ID NO: 4995 - protein, 9 aa, Triticum sp.
QQPEQPFPQ

SEQ ID NO: 4996 - protein, 9 aa, Triticum sp.
PQPEQPFCQ

SEQ ID NO: 4997 - protein, 9 aa, Triticum sp.
QQPFPEQPQ

SEQ ID NO: 4998 - protein, 9 aa, Triticum sp.
PFPQPEQPF

SEQ ID NO: 4999 - protein, 9 aa, Triticum sp.
PQPEQPFPW

SEQ ID NO: 5000 - protein, 9 aa, Triticum sp.
PFSEQEQPV

SEQ ID NO: 5001 - protein, 9 aa, Triticum sp.
FSQQQESPF

SEQ ID NO: 5002 - protein, 9 aa, Triticum sp.
PFPQPEQPF

SEQ ID NO: 5003 - protein, 9 aa, Triticum sp.
PQPEQPFPQ

SEQ ID NO: 5004 - protein, 9 aa, Triticum sp.
PIPEQPQPY

SEQ ID NO: 5005 - protein, 9 aa, Triticum sp.
PFPQPEQPF

SEQ ID NO: 5006 - protein, 9 aa, Triticum sp.
PQPEQPFPQ

SEQ ID NO: 5007 - protein, 9 aa, Triticum sp.
PYPEQEEPF

SEQ ID NO: 5008 - protein, 9 aa, Triticum sp.
PYPEQEQPF

SEQ ID NO: 5009 - protein, 9 aa, Triticum sp.
PFSEQEQPV

SEQ ID NO: 5010 - protein, 9 aa, Triticum sp.
EGSFQPSQE

SEQ ID NO: 5011 - protein, 9 aa, Triticum sp.
EQPQQPFPQ

SEQ ID NO: 5012 - protein, 9 aa, Triticum sp.
EQPQQPYPE

SEQ ID NO: 5013 - protein, 9 aa, Triticum sp.
QFYYPTSPQ

SEQ ID NO: 5014 - protein, 9 aa, Triticum sp.
EGSFQPSQE

SEQ ID NO: 5015 - protein, 9 aa, Triticum sp.
PQQSFPEQE

SEQ ID NO: 5016 - protein, 9 aa, Triticum sp.
QFYYPTSPQ

SEQ ID NO: 5017 - protein, 239 aa, Homo sapiens; identical to SEQ ID NO: 4577

SEQ ID NO: 5018 - protein, 20 aa, Homo sapiens
SPATWTTRGFVFTRHSQTTA

SEQ ID NO: 5019 - protein, 21 aa, Homo sapiens
VFTRHSQTTAIPSCPEGTVPL

SEQ ID NO: 5020 - protein, 20 aa, Homo sapiens
IPSCPEGTVPLYSGFSFLFV

SEQ ID NO: 5021 - protein, 20 aa, Homo sapiens
LYSGFSFLFVQGNQRAHGQD

SEQ ID NO: 5022 - protein, 20 aa, Homo sapiens
FTTMPFLFCNVNDVCNFASR

SEQ ID NO: 5023 - protein, 21 aa, Homo sapiens
VNDVCNFASRNDYSYWLSTPA

SEQ ID NO: 5024 - protein, 20 aa, Homo sapiens
TGRALEPYISRCTVCEGPAI

SEQ ID NO: 5025 - protein, 19 aa, Homo sapiens
RCTVCEPAIAIAVHSQTTD

SEQ ID NO: 5026 - protein, 20 aa, Homo sapiens
IPPCPHGWISLWKGFSFIMF

SEQ ID NO: 5027 - protein, 20 aa, Homo sapiens
LWKGFSFIMFTSAGSEGTQG

SEQ ID NO: 5028 - protein, 20 aa, Homo sapiens
NSYSFWLASLNPERMFRKPI

SEQ ID NO: 5029 - protein, 19 aa, Mus musculus
ATGTRMRGFIFTRHSTTAI

SEQ ID NO: 5030 - protein, 20 aa, Mus musculus
FIFTRHSQTTAIPSCPEGTQ

SEQ ID NO: 5031 - protein, 20 aa, Mus musculus
TTAIPSCPEGTQPLYSGFSL

SEQ ID NO: 5032 - protein, 20 aa, Mus musculus
EGTQPLYSGFSLLFVQGNKR

SEQ ID NO: 5033 - protein, 20 aa, Mus musculus
FLFCNINNVCNFASRNDYSY

SEQ ID NO: 5034 - protein, 20 aa, Mus musculus
VCNFASRNDYSYWLSTPALM

SEQ ID NO: 5035 - protein, 20 aa, Mus musculus
APISGRALEPYISRCTVCEG

SEQ ID NO: 5036 - protein, 20 aa, Mus musculus
EPYISRCTVCEGPAMAIAVH

SEQ ID NO: 5037 - protein, 20 aa, Mus musculus
AIPPCPQDWVSLWKGFSFIM

SEQ ID NO: 5038 - protein, 21 aa, Mus musculus
WVSLWKGEFSFIMFTSAGSEG

SEQ ID NO: 5039 - protein, 20 aa, Mus musculus
SFWLASLNPERMFRKPIPST

SEQ ID NO: 5040 - protein, 20 aa, Triticum sp.
PQPFPPQLPYPQPQLPYPQP

SEQ ID NO: 5041 - protein, 20 aa, Triticum sp.
MQLQPFPQPQLPYPQPQLPY

SEQ ID NO: 5042 - protein, 20 aa, Triticum sp.
QPFPQPQQPFPWQPQQPFPQ

SEQ ID NO: 5043 - protein, 20 aa, Triticum sp.
PQQPQQPFPQPQQPIPVQPQ

SEQ ID NO: 5044 - protein, 20 aa, Triticum sp.
PQQQQPFPQPQQPFSQQPQQ

SEQ ID NO: 5045 - protein, 20 aa, Triticum sp.
QQPQQPFPQPQLPFPQQSEQ

SEQ ID NO: 5046 - protein, 20 aa, Triticum sp.
WPQQQPFPQPQQPFCQQPQQ

SEQ ID NO: 5047 - protein, 20 aa, Triticum sp.
LQLQPFPQPQLPYSQPQPFR

SEQ ID NO: 5048 - protein, 20 aa, Triticum sp.
LQPFPQPQPFLPQLPYPQPQ

SEQ ID NO: 5049 - protein, 20 aa, Triticum sp.
SQQPQQQFSQPQQQFPQPQQ

SEQ ID NO: 5050 - protein, 20 aa, Triticum sp.
QAFPQPQQTFPHQPQQQFPQ

SEQ ID NO: 5051 - protein, 20 aa, Triticum sp.
CKVFLQQQCSPVAMPQRLAR

SEQ ID NO: 5052 - protein, 20 aa, Triticum sp.
LQLQPFPQPQLPYLQPQPFR

SEQ ID NO: 5053 - protein, 20 aa, Triticum sp.
QQQFIQPQQPFPQQPQQTYP

SEQ ID NO: 5054 - protein, 20 aa, Triticum sp.
SHIPGLERPWQQQPLPPQQT

SEQ ID NO: 5055 - protein, 20 aa, Triticum sp.
SQQPQQPFPQPQQQFPQPQQ

SEQ ID NO: 5056 - protein, 20 aa, Triticum sp.
QQPFPQPQQPQLPFPQQPQQ

SEQ ID NO: 5057 - protein, 20 aa, Triticum sp.
PQLPYPQPQLPYPQPQPFRP

SEQ ID NO: 5058 - protein, 20 aa, Triticum sp.
QPFPQPQQPFPWQPQQPFPQ

SEQ ID NO: 5059 - protein, 20 aa, Triticum sp.
FPELQQPIPQQPQQPFPLQP

SEQ ID NO: 5060 - protein, 20 aa, Triticum sp.
QGQQGYYPISPQQSGQGQQP

SEQ ID NO: 5061 - protein, 20 aa, Triticum sp.
LQPGQGQPGYYPTSPQQIGQ

SEQ ID NO: 5062 - protein, 20 aa, Triticum sp.
QQFLQPQQPFPQQPQQPYPQ

SEQ ID NO: 5063 - protein, 20 aa, Triticum sp.
PGQGQSGYYPTSPQQSGQKQ

SEQ ID NO: 5064 - protein, 20 aa, Triticum sp.
TPIQPQQPFPQQPQQPQQPF

SEQ ID NO: 5065 - protein, 20 aa, Triticum sp.
PQQPQQPFPLQPQQPFPQQP

SEQ ID NO: 5066 - protein, 20 aa, Triticum sp.
PFTQPQQPTPIQPQQPFPQQ

SEQ ID NO: 5067 - protein, 20 aa, Triticum sp.
PQQPFPQPQQTFPQQPQLPF

SEQ ID NO: 5068 - protein, 20 aa, Triticum sp.
GQGQSGYYPTSPQQSGQEAT

SEQ ID NO: 5069 - protein, 20 aa, Triticum sp.
PLQPQQPFPQQPQQPFPQPQ

SEQ ID NO: 5070 - protein, 20 aa, Triticum sp.
QPFPQLQQPQQPLPQPQQPQ

SEQ ID NO: 5071 - protein, 20 aa, Triticum sp.
QQPFPQQPQQPFPQPQQPIP

SEQ ID NO: 5072 - protein, 20 aa, Triticum sp.
PQQPFPQPQQTFPQQPQLPF

SEQ ID NO: 5073 - protein, 20 aa, Triticum sp.
VAHAIIMHQQQQQQQEQKQQ

SEQ ID NO: 5074 - protein, 20 aa, Triticum sp.
PQQPFPQQPQQQFPQPQQPQ

SEQ ID NO: 5075 - protein, 20 aa, Triticum sp.
QQPAQYEVIRSLVLRTLPNM

SEQ ID NO: 5076 - protein, 20 aa, Triticum sp.
ATANMQVDPSGQVQWPQQQP

SEQ ID NO: 5077 - protein, 20 aa, Hordeum vulgare
QPFPQPQQPFPWQPQQPFPQ

SEQ ID NO: 5078 - protein, 20 aa, Hordeum vulgare
WQPQQPFPQPQQPFPLQPQQ

SEQ ID NO: 5079 - protein, 20 aa, Hordeum vulgare
QPQQPFPQPQQPIPYQPQQP

SEQ ID NO: 5080 - protein, 20 aa, Hordeum vulgare
QPQQPQPFPQQPVPQQPQPY

SEQ ID NO: 5081 - protein, 20 aa, Hordeum vulgare
PQPFPQQPIPQQPQPYPQQP

SEQ ID NO: 5082 - protein, 20 aa, Hordeum vulgare
QQPQPFSQQPIPQQPQPYPQ

SEQ ID NO: 5083 - protein, 20 aa, Hordeum vulgare
QSQQQFPQPQQPFPQQPQQP

SEQ ID NO: 5084 - protein, 20 aa, Hordeum vulgare
PQPFPQQPIPQQPQPYPQQP

SEQ ID NO: 5085 - protein, 20 aa, Hordeum vulgare
QQPFPQQPFPQQPQPYPQQP

SEQ ID NO: 5086 - protein, 20 aa, Hordeum vulgare
PQQPQQPFPQPQQPFSWQPQ

SEQ ID NO: 5087 - protein, 20 aa, Hordeum vulgare
QPQPYPQQPQPYPQQPFQPQ

SEQ ID NO: 5088 - protein, 20 aa, Hordeum vulgare
QQPFPQQPFPQQPQPYPQQP

SEQ ID NO: 5089 - protein, 20 aa, Hordeum vulgare
PQPYPQQPQPFPQQPPFCQQ

SEQ ID NO: 5090 - protein, 20 aa, Hordeum vulgare
FQQPQQSYPVQPQQPFPQPQ

SEQ ID NO: 5091 - protein, 20 aa, Hordeum vulgare
YPQQPQPFPQQPIPQQPQPY

SEQ ID NO: 5092 - protein, 20 aa, Hordeum vulgare
QQQPFPQQPIPQQPQPYPQQ

SEQ ID NO: 5093 - protein, 20 aa, Hordeum vulgare
QPQQPQPFPQQPVPQQPQPY

SEQ ID NO: 5094 - protein, 20 aa, Hordeum vulgare
QPQPFPQQPIPLQPHQPYTQ

SEQ ID NO: 5095 - protein, 20 aa, Hordeum vulgare
LPRPQQPFPWQPQQPFPQPQ

SEQ ID NO: 5096 - protein, 20 aa, Hordeum vulgare
QQPFPLQPQQPFPQPQPFPQ

SEQ ID NO: 5097 - protein, 20 aa, Hordeum vulgare
PFPQQPQQPFPQPQQPFRQQ

SEQ ID NO: 5098 - protein, 20 aa, Hordeum vulgare
PQQPFQPQQPFPQQTIPQQP

SEQ ID NO: 5099 - protein, 20 aa, Hordeum vulgare
NPLQPQQPFPLQPQPPQQPF

SEQ ID NO: 5100 - protein, 20 aa, Hordeum vulgare
NPLQPQQPFPLQPQPPQQPF

SEQ ID NO: 5101 - protein, 20 aa, Hordeum vulgare
PFPQQPQQPFPQPQQPFRQQ

SEQ ID NO: 5102 - protein, 20 aa, Hordeum vulgare
QPQQPFPLQPQQPFPWQPQQ

SEQ ID NO: 5103 - protein, 20 aa, Hordeum vulgare
TFPPSQQPNPLQPQQPFPLQ

SEQ ID NO: 5104 - protein, 20 aa, Hordeum vulgare
PQQTIPQQPQQPFPLQPQQP

SEQ ID NO: 5105 - protein, 20 aa, Hordeum vulgare
QPQQPFSFSQQPQQPFPLQP

SEQ ID NO: 5106 - protein, 20 aa, Hordeum vulgare
QQPFPQQPFPQQPQPYPQQP

SEQ ID NO: 5107 - protein, 20 aa, Secale cereale
QQLPLQPQQPFPQPQQPIPQ

SEQ ID NO: 5108 - protein, 20 aa, Secale cereale
SIPQPQQPFPQPQQPFPQSQ

SEQ ID NO: 5109 - protein, 20 aa, Secale cereale
QPFPQPQQPTPIQPQQPFPQ

SEQ ID NO: 5110 - protein, 20 aa, Secale cereale
QPFPQPQQPTPIQPQQPFPQ

SEQ ID NO: 5111 - protein, 20 aa, Secale cereale
PAPIQPQQPFPQQPQQPFPQ

SEQ ID NO: 5112 - protein, 20 aa, Secale cereale
PQQPFPQQPEQIIPQQPQQP

SEQ ID NO: 5113 - protein, 20 aa, Secale cereale
QYSPYQPQQPFPQPQQPTPI

SEQ ID NO: 5114 - protein, 20 aa, Secale cereale
SQQPQRPQQPFPQQPQQIIP

SEQ ID NO: 5115 - protein, 20 aa, Secale cereale
QQLPLQPQQPFPQPQQPIPQ

SEQ ID NO: 5116 - protein, 20 aa, Secale cereale
FPLQPQQPFPQQPEQIISQQ

SEQ ID NO: 5117 - protein, 20 aa, Secale cereale
PQQPFPQQPEQIIPQQPQQP

SEQ ID NO: 5118 - protein, 20 aa, Secale cereale
FPQQPQQPFPQPQQQLPLQP

SEQ ID NO: 5119 - protein, 20 aa, Secale cereale
SPQPQQPYPQQPFPQQPQQP

SEQ ID NO: 5120 - protein, 20 aa, Secale cereale
QQPQQPFPLQPQQPVPQQPQ

SEQ ID NO: 5121 - protein, 20 aa, Secale cereale
QPQQIIPQQPQQPFPLQPQQ

SEQ ID NO: 5122 - protein, 20 aa, Secale cereale
PQQPFPQQPEQIIPQQPQQP

SEQ ID NO: 5123 - protein, 20 aa, Secale cereale
QTQQSIPQPQQPFPQPQQPF

SEQ ID NO: 5124 - protein, 20 aa, Secale cereale
QQPFLLQPQQPFSQPQQPFL

SEQ ID NO: 5125 - protein, 20 aa, Secale cereale
QQPQQPFPLQPQQPVPQQPQ

SEQ ID NO: 5126 - protein, 20 aa, Secale cereale
EQIISQQPFPLQPQQPFSQP

SEQ ID NO: 5127 - protein, 20 aa, Secale cereale
NMQVGPSGQVEWPQQQPLPQ

SEQ ID NO: 5128 - protein, 20 aa, Secale cereale
PQQLFPLPQQPFPQPQQPFP

SEQ ID NO: 5129 - protein, 20 aa, Secale cereale
PQTQQPQQPFPQPQQPQQLF

SEQ ID NO: 5130 - protein, 20 aa, Secale cereale
SPQQPQLPFPQPQQPFVVVV

SEQ ID NO: 5131 - protein, 20 aa, Secale cereale
FPQQPEQIISQQPQQPFPLQ

SEQ ID NO: 5132 - protein, 20 aa, Secale cereale
PAPIQPQQPFPQQPQQPFPQ

SEQ ID NO: 5133 - protein, 20 aa, Secale cereale
PQEPQQLFPQSQQPQQPFPQ

SEQ ID NO: 5134 - protein, 20 aa, Secale cereale
SPQPQQPYPQQPFPQQPQQP

SEQ ID NO: 5135 - protein, 20 aa, Secale cereale
PTPIQPQQPFPQRPQQPFPQ

SEQ ID NO: 5136 - protein, 15 aa, Artificial Sequence
  NPL033
LQPFPQPELPYPQPQ

SEQ ID NO: 5137 - protein, 14 aa, Artificial Sequence
  NPL038
QPFPQPEQPFPWQP

SEQ ID NO: 5138 - protein, 15 aa, Artificial Sequence
  NPL034
PEQPIPEQPQPYPQQ

SEQ ID NO: 5139 - protein, 16 aa, Artificial Sequence
  gluten derived peptide
PQQPFPQPEQPFPWQP

SEQ ID NO: 5140 - protein, 16 aa, Artificial Sequence
  gluten derived peptide
FPEQPIPEQPQPYPQQ

What is claimed is:

1. A method of inducing monocyte and/or neutrophil apoptosis in a subject comprising administering to said subject in need thereof an effective amount of a pharmaceutical composition comprising negatively charged poly (lactic-co-glycolic acid) (PLGA) particles and a pharmaceutically acceptable carrier, wherein said particles are free from attached or embedded peptides, antigens, and additional drugs or therapeutics, wherein the subject has an autoimmune disorder, an inflammatory disease is a transplant recipient, has ischemic reperfusion injury, atherosclerosis, has suffered from a cardiac infraction, or has a bacterial or viral infection, and wherein the administration induces monocyte and/or neutrophil apoptosis in the subject.

2. The method of claim 1, wherein the particles are carboxylated.

3. The method of claim 1, wherein the particles have a zeta potential between −75 mV and 0 mV.

4. The method of claim 1, wherein the diameter of said negatively charged particles is between about 0.1 µm to about 10 µm.

5. The method of claim 1, wherein the subject has an ischemic reperfusion injury, atherosclerosis, or has suffered from a cardiac infarction.

6. The method of claim 1, wherein the diameter of said negatively charged particles is about 0.5 µm.

7. A method for removing pro-inflammatory mediators from the inflammatory milieu in a subject in need thereof with an inflammatory disorder comprising intravenously administering to said subject an effective amount of a pharmaceutical composition comprising negatively charged poly (lactic-co-glycolic acid) (PLGA) particles and a pharmaceutically acceptable carrier, wherein said particles are free from attached or embedded peptides, antigens, and additional drugs or therapeutics, wherein the subject has an autoimmune disorder, an inflammatory disease is a transplant recipient, has ischemic reperfusion injury, atherosclerosis, has suffered from a cardiac infarction, or has a bacterial or viral infection, and wherein the administration removes pro-inflammatory mediators from the inflammatory milieu in the subject.

8. The method of claim 7, wherein said particles are carboxylated.

9. The method of claim 7, wherein the particles have a zeta potential between −75 mV and 0 mV.

10. The method of claim 7, wherein the diameter of said negatively charged particles is between about 0.1 µm to about 10 µm.

11. The method of claim 7, wherein the subject has an ischemic reperfusion injury, atherosclerosis, or has suffered from a cardiac infarction.

12. The method of claim 7, wherein the diameter of said negatively charged particles is about 0.5 µm.

13. A method of inducing monocyte and/or neutrophil apoptosis in a subject in need thereof comprising intravenously administering to said subject an effective amount of a pharmaceutical composition comprising negatively charged particles and a pharmaceutically acceptable carrier, wherein said particles are free from attached or embedded peptides, antigens, and additional drugs or therapeutics; wherein said particles are poly(lactic-co-glycolic acid) (PLGA) particles; wherein said particles have a molar ratio of polylactic acid to polyglycolic acid of about 50:50; wherein said particles have a zeta potential between −100 mV and 0 mV, wherein the subject has an autoimmune disorder, an inflammatory disease, is a transplant recipient, has ischemic reperfusion injury, atherosclerosis, has suffered from a cardiac infarction, or has a bacterial or viral infection and wherein the administration induces monocyte and/or neutrophil apoptosis in the subject.

14. The method of claim 13, wherein the particles are carboxylated.

15. The method of claim 13, wherein the diameter of said negatively charged particles is between 0.1 µm and 10 µm.

16. The method of claim 13, wherein the diameter of said negatively charged particles is about 0.5 µm.

17. The method of claim 13, wherein the subject has an ischemic reperfusion injury, atherosclerosis, or has suffered from a cardiac infarction.

18. A method for removing pro-inflammatory mediators from the inflammatory milieu in a subject in need thereof with an inflammatory disorder comprising intravenously administering to said subject an effective amount of a pharmaceutical composition comprising negatively charged particles and a pharmaceutically acceptable carrier, wherein said particles are free from attached or embedded peptides, antigens, and additional drugs or therapeutics; wherein said particles are poly(lactic-co-glycolic acid) (PLGA) particles; wherein said particles have a molar ratio of polylactic acid to polyglycolic acid to about 50:50; wherein particles have a zeta potential between −100 mV and 0 mV wherein the subject has an autoimmune disorder, an inflammatory disease, is a transplant recipient, has ischemic reperfusion injury, atherosclerosis, has suffered from a cardiac infarction, or has a bacterial or viral infection, and wherein the administration removes pro-inflammatory mediators from the inflammatory milieu in the subject.

19. The method of claim 18, wherein said particles are carboxylated.

20. The method of claim 18, wherein the diameter of said negatively charged particles is between about 0.1 µm to about 10 µm.

21. The method of claim 18, wherein the subject has an ischemic reperfusion injury, atherosclerosis, or has suffered from a cardiac infarction.

22. The method of claim 18, wherein the diameter of said negatively charged particles is about 0.5 µm.

23. A method for removing pro-inflammatory mediators from the inflammatory milieu in a subject in need thereof with an inflammatory disorder comprising intravenously administering to said subject an effective amount of a pharmaceutical composition comprising negatively charged particles and a pharmaceutically acceptable carrier, wherein said particles are free from attached or embedded peptides, antigens, and additional drugs or therapeutics; wherein said particles are poly(lactic-co-glycolic acid) (PLGA) particles; wherein said particles have a molar ratio of polylactic acid to polyglycolic acid of about 50:50; wherein said particles have a zeta potential between −100 mV and 0 mV; wherein said subject has an ischemic reperfusion injury, atherosclerosis, or has suffered from a cardiac infarction, and wherein the administration removes pro-inflammatory mediators from the inflammatory milieu in the subject.

\* \* \* \* \*